US012742152B2

(12) United States Patent
Chaudhary

(10) Patent No.: US 12,742,152 B2
(45) Date of Patent: Sep. 22, 2026

(54) DIVERSE ANTIGEN BINDING DOMAINS, NOVEL PLATFORMS AND OTHER ENHANCEMENTS FOR CELLULAR THERAPY

(71) Applicant: Angeles Therapeutics, Inc., Toluca Lake, CA (US)

(72) Inventor: Preet M. Chaudhary, Toluca Lake, CA (US)

(73) Assignee: Angeles Therapeutics, Inc., Toluca Lake, CA (US)

( * ) Notice: Subject to any disclaimer, the term of this patent is extended or adjusted under 35 U.S.C. 154(b) by 1492 days.

(21) Appl. No.: 15/734,203

(22) PCT Filed: Jun. 1, 2019

(86) PCT No.: PCT/US2019/035096
§ 371 (c)(1),
(2) Date: Dec. 1, 2020

(87) PCT Pub. No.: WO2019/232503
PCT Pub. Date: Dec. 5, 2019

(65) Prior Publication Data

US 2021/0137977 A1 May 13, 2021

Related U.S. Application Data

(60) Provisional application No. 62/679,741, filed on Jun. 1, 2018.

(51) Int. Cl.

| | |
|---|---|
| ***C12N 5/0783*** | (2010.01) |
| ***A61K 40/11*** | (2025.01) |
| ***A61K 40/31*** | (2025.01) |
| ***A61K 40/42*** | (2025.01) |
| ***A61K 40/50*** | (2025.01) |
| ***A61P 35/00*** | (2006.01) |
| ***C07K 14/705*** | (2006.01) |

(52) U.S. Cl.
CPC ............ *C12N 5/0636* (2013.01); *A61K 40/11* (2025.01); *A61K 40/31* (2025.01); *A61K 40/4202* (2025.01); *A61K 40/4204* (2025.01); *A61K 40/4205* (2025.01); *A61K 40/4211* (2025.01); *A61K 40/4215* (2025.01); *A61K 40/4217* (2025.01); *A61K 40/4221* (2025.01); *A61K 40/4255* (2025.01); *A61K 40/4257* (2025.01); *A61K 40/4261* (2025.01); *A61K 40/4276* (2025.01); *A61P 35/00* (2018.01); *C07K 14/7051* (2013.01); *C12N 5/0646* (2013.01); *A61K 40/50* (2025.01); *A61K 2239/28* (2023.05); *A61K 2239/31* (2023.05); *A61K 2239/38* (2023.05); *A61K 2239/48* (2023.05); *A61K 2239/59* (2023.05); *C07K 2319/03* (2013.01); *C12N 2510/00* (2013.01)

(58) Field of Classification Search
None
See application file for complete search history.

(56) References Cited

U.S. PATENT DOCUMENTS

| | | | |
|---|---|---|---|
| 5,199,942 | A | 4/1993 | Gillis |
| 5,399,346 | A | 3/1995 | Anderson et al. |
| 5,580,859 | A | 12/1996 | Felgner et al. |
| 5,589,466 | A | 12/1996 | Felgner et al. |
| 5,858,358 | A | 1/1999 | June et al. |
| 5,883,223 | A | 3/1999 | Gray |
| 6,352,694 | B1 | 3/2002 | June et al. |
| 6,534,055 | B1 | 3/2003 | June et al. |
| 6,692,964 | B1 | 2/2004 | June et al. |
| 6,703,199 | B1 | 3/2004 | Koide |
| 6,797,514 | B2 | 9/2004 | Berenson et al. |
| 6,867,041 | B2 | 3/2005 | Berenson et al. |
| 6,887,466 | B2 | 5/2005 | June et al. |
| 6,905,680 | B2 | 6/2005 | June et al. |
| 6,905,681 | B1 | 6/2005 | June et al. |
| 6,905,874 | B2 | 6/2005 | Berenson et al. |
| 7,067,318 | B2 | 6/2006 | June et al. |
| 7,144,575 | B2 | 12/2006 | June et al. |
| 7,172,869 | B2 | 2/2007 | June et al. |
| 7,175,843 | B2 | 2/2007 | June et al. |
| 7,232,566 | B2 | 6/2007 | June et al. |

(Continued)

FOREIGN PATENT DOCUMENTS

| | | | |
|---|---|---|---|
| CN | 107849112 | A | 3/2018 |
| CO | 2019007092 | A2 | 9/2019 |

(Continued)

OTHER PUBLICATIONS

Firor et al., "From humble beginnings to success in the clinic: Chimeric antigen receptor-modified T-cells and implications for immunotherapy", Exp Biol Med (Maywood), May 7, 2015, pp. 1-12.
Office Action, Application No. 108119201, Intellectual Property Office of Taiwan, Sep. 6, 2023, Cover Page Only.
Alsuwaidi, Khalfan Ahmed, Office Action, UAE Patent Office, Application No. P6001707/2020, Dec. 20, 2023.

(Continued)

*Primary Examiner* — Christopher M Babic
*Assistant Examiner* — Kimberly A Aron
(74) *Attorney, Agent, or Firm* — IPath, PLC; Steven J. Miller

(57) ABSTRACT

The disclosure provides diverse antigen binding domains and platforms for construction of conventional and next generation chimeric antigen receptors for adoptive cellular therapies for cancer, infection, allergic, degenerative and immune disorders, Also provided are approaches for activation and expansion of immune T cells for adoptive cellular therapies for cancer, infection, allergic, degenerative and immune disorders.

20 Claims, 5 Drawing Sheets

Specification includes a Sequence Listing.

(56) References Cited

U.S. PATENT DOCUMENTS

| | | | | |
|---|---|---|---|---|
| 2005/0100543 | A1 | 5/2005 | Hansen et al. | |
| 2005/0175606 | A1 | 8/2005 | Huang et al. | |
| 2006/0121005 | A1 | 6/2006 | Berenson et al. | |
| 2007/0014794 | A1 | 1/2007 | Carter et al. | |
| 2012/0134970 | A1* | 5/2012 | Yang | A61P 31/00 435/348 |
| 2012/0213783 | A1 | 8/2012 | Rosenberg et al. | |
| 2014/0256706 | A1 | 9/2014 | Wang et al. | |
| 2015/0110760 | A1 | 4/2015 | Zhang et al. | |
| 2016/0046724 | A1* | 2/2016 | Brogdon | C07K 14/7051 435/328 |
| 2017/0183418 | A1 | 6/2017 | Galletto | |
| 2018/0085457 | A1 | 3/2018 | Lu et al. | |

FOREIGN PATENT DOCUMENTS

| | | | | |
|---|---|---|---|---|
| EA | 201991343 A1 | | 3/2020 | |
| WO | WO-9957268 A1 | * | 11/1999 | C07K 14/7051 |
| WO | 2006/020258 A2 | | 2/2006 | |
| WO | 2007/024715 A2 | | 3/2007 | |
| WO | 2010/085660 A2 | | 7/2010 | |
| WO | 2012/138475 A1 | | 10/2012 | |
| WO | 2013/059343 A1 | | 4/2013 | |
| WO | 2014/160030 A2 | | 10/2014 | |
| WO | 2015/117229 A1 | | 8/2015 | |
| WO | 2016/174852 A1 | | 11/2016 | |
| WO | 2016/187349 A1 | | 11/2016 | |
| WO | 2016/1748521 A1 | | 11/2016 | |
| WO | 2017/070608 A1 | | 4/2017 | |
| WO | 2017/173403 A1 | | 10/2017 | |
| WO | 2017172981 A2 | | 10/2017 | |
| WO | 2018/053542 A1 | | 3/2018 | |
| WO | 2018/102795 A2 | | 6/2018 | |
| WO | 2019/067805 A1 | | 4/2019 | |
| WO | 2019/232503 A1 | | 12/2019 | |
| WO | 2022/178367 A2 | | 8/2022 | |

OTHER PUBLICATIONS

Office Action, China Intellectual Property Administration, Application No. 201980049331.5, Aug. 12, 2023.

Offermann, Stefanie, Extended European Search Report, Application No. 19811044.7, European Patent Office, Feb. 9, 2022.

Walseng, Even et al., "A TCR-based Chimeric Antigen Receptor", Scientific Reports, vol. 7, No. 1, Sep. 6, 2017, pp. 1-10.

Lee, Sun Hwa, International Preliminary Report on Patentability and Written Opinion, PCT/US2019/035096, The International Bureau of WIPO, Dec. 10, 2020.

Young, Lee W., International Search Report and Written Opinion, PCT/US2019/035096, United States Patent & Trademark Office, Oct. 22, 2019.

Barrett et al., "Treatment of advanced leukemia in mice with mRNA engineered T cells", Human Gene Therapy, vol. 22, No. 12, pp. 1575-1586, Dec. 2011.

Berger et al., "Adoptive transfer of virus-specific and tumor-specific T cell immunity", Curr Opin Immunol., vol. 21, No. 2, 15 pages, Apr. 2009.

Brown et al., "Bioactivity and Safety of IL13Rα2-Redirected Chimeric Antigen Receptor CD8+ T Cells in Patients with Recurrent Glioblastoma", Clinical Cancer Research, vol. 21, No. 18, pp. 4062-4072, Sep. 15, 2015.

Chothia et al., "Canonical Structures for the Hypervariable Regions of Immunoglobulins", Journal of Molecular Biology, vol. 196, pp. 901-917, 1987.

Ding et al., "High-throughput Nuclear Delivery and Rapid Expression of DNA via Mechanical and Electrical Cell-Membrane Disruption", Nat. Biomed. Eng., vol. 1, 15 pages, 2017.

Eyquem et al., "Targeting a CAR to the TRAC locus with CRISPR/Cas9 enhances tumour rejection", Nature, vol. 543, No. 7643, pp. 113-117, 2017.

Henderson et al., "Comparison of the effects of FK-506, cyclosporin A and rapamycin on IL-2 production", Immunology, vol. 73, pp. 316-321, 1991.

Hollinger et al., ""Diabodies": small bivalent and bispecific antibody fragments", Proc. Natl. Acad. Sci., vol. 90, pp. 6444-6448, 1993.

Hollinger et al., "Engineered Antibody Fragments and the Rise of Single Domains", Nature Biotechnology, vol. 23, No. 9, pp. 1126-1136, Sep. 2005.

Hopp et al., "Prediction of protein antigenic determinants from amino acid sequences" Proc. Nati. Acad. Sci., vol. 78, No. 6, pp. 3824-3828, Jun. 1981.

Huston et al., "Protein engineering of antibody binding sites: recovery of specific activity in an anti-digoxin single-chain Fv analogue produced in *Escherichia coli*", Proc. Natl. Acad. Sci., vol. 85, pp. 5879-5883, Aug. 1988.

Kabat et al., "Sequences of Proteins of Immunological Interest", U.S. Dept. of Health and Human Services, vol. 1, 1246 pages, 1991.

Kabat et al., "Unusual Distributions of Amino Acids in Complementarity-determining (Hypervariable) Segments of Heavy and Light Chains of Immunoglobulins and Their Possible Roles in Specificity of Antibody-combining Sites", Journal of Biological Chemistry, vol. 252, No. 19, pp. 6609-6616, Oct. 10, 1977.

Kyte et al., "A simple method for displaying the hydropathic character of a protein", Journal of Molecular Biology, vol. 157, Issue 1, pp. 105-132, May 1982.

Liu et al., "Calcineurin is a common target of cyclophilin-cyclosporin A and FKBP-FK506 complexes", Cell, vol. 66, Issue 4, pp. 807-815, Aug. 23, 1991.

Lwai et al., "PD-1 blockade inhibits hematogenous spread of poorly immunogenic tumor cells by enhanced recruitment of effector T cells", International Immunology, vol. 17, No. 2, pp. 133-144, Feb. 2005.

Milone et al., "Chimeric Receptors Containing CD137 Signal Transduction Domains Mediate Enhanced Survival of T Cells and Increased Antileukemic Efficacy in Vivo", Molecular Therapy, vol. 17, No. 8, pp. 1453-1464, Aug. 2009.

Ruella et al., "Induction of resistance to chimeric antigen receptor T cell therapy by transduction of a single leukemic B cell", Nat. Med., vol. 24, No. 10, pp. 1499-1503, Oct. 2018.

Tolani et al., "Targeting Myc in KSHV-associated primary effusion lymphoma with BET bromodomain inhibitors", Oncogene, vol. 33, No. 22, pp. 2928-2937, May 29, 2014.

Bridgeman et al., "The Optimal Antigen Response of Chimeric Antigen Receptors Harboring T the CD3ζ Transmembrane Domain Is Dependent upon Incorporation of the Receptor into the Endogenous TCR/CD3 Complex", J Immunol, May 17, 2010, 184:6938-6949.

Dunbar et al., "Examining Variable Domain Orientations in Antigen Receptors Gives Insight into TCR-Like Antibody Design", PLoS Computational Biology, vol. 10, No. 9, e1003852, 10 pages, 2014.

Kouro et al., "Exhaustion of CAR T cells: potential causes and solutions", Journal of Translational Medicine, vol. 20, No. 239, 10 pages, 2022.

Mazinani et al., "CAR-T cell potency: from structural elements to vector backbone components", Biomarker Research, vol. 10, No. 70, 24 pages, 2022.

Nolan et al., "Bypassing immunization: optimized design of "designer T cells" against carcinoembryonic antigen (CEA)-expressing tumors, and lack of suppression by soluble CEA", Clinical Cancer Research, vol. 5, No. 12, pp. 3928-3941, Dec. 1999.

Spiegel et al., "CAR T cells with dual targeting of CD19 and CD22 in adult patients with recurrent or refractory B cell malignancies: a phase 1 trial", Nature Medicine, vol. 27, pp. 1419-1431, Aug. 2021.

Govers C. et al., "T Cell Receptor Fused to CD3ζ: Transmembrane Domain of CD3ζ Prevents TCR Mis-Pairing, Whereas Complete CD3ζ Directs Functional TCR Expression", The Open Gene Therapy Journal, 2011, 4, 11-22.

Sebestyen Z. et al., "HHuman TCR That Incorporate CD3ζ Induce Highly Preferred Pairing between TCRα and β Chains following Gene Transfer," J. Immunol., Jun. 1, 2008, vol. 180, No. 11, pp. 7736-7746.

Tan Wei Min, Kenneth, Search Report and Written Opinion, Intellectual Property Office of Singapore, Jul. 18, 2022.

(56) References Cited

OTHER PUBLICATIONS

Dunbar, J et al. "Examining Variable Domain Orientations in Antigen Receptors Gives Insight into TCR-Like Antibody Design" Computational Biology, Sep. 2014, vol. 10, issue 9, pp. 1-10, Oxford U.K.
Gross, G et al. "Endowing T cells with antibody specificity using chimeric T cell receptors" FASEB Journal, Dec. 1992, vol. 6, pp. 3370-3378, Rehovot, Israel.
Spiegel, J et al. "CAR T cells with dual targeting of CD19 and CD22 in adult patients with recurrent or refractory B cell malignancies: a phase 1 trial" Nature Medicine, Aug. 2021, vol. 27, pp. 1419-1431.
Eshar, Z et al. "The Emergence of T-Bodies/CAR T Cells" The Cancer Journal, Mar./Apr. 2014, vol. 20, issue 2, pp. 123-126, Lippincott Williams & Watkins.

* cited by examiner

DIVERSE ANTIGEN BINDING DOMAINS, NOVEL PLATFORMS AND OTHER ENHANCEMENTS FOR CELLULAR THERAPY

CROSS REFERENCE TO RELATED APPLICATIONS

This application is a U.S. National Phase Application filed under 35 U.S.C. § 371 and claim priority to International Application No. PCT/US2019/035096, filed Jun. 1, 2019, which application claims priority to U.S. Provisional Application No. 62/679,741, filed Jun. 1, 2018, the disclosures of which are incorporated herein for all purposes.

FIELD OF INVENTION

Provided herein are diverse antigen binding domains and novel platforms for construction of conventional and next generation chimeric antigen receptors for adoptive cellular therapies for cancer, infection, allergic, degenerative and immune disorders. Also provided are novel approaches for activation and expansion of immune T cells for adoptive cellular therapies for cancer, infection, allergic, degenerative and immune disorders.

INCORPORATION BY REFERENCE OF SEQUENCE LISTING

Accompanying this filing is a Sequence Listing entitled "Sequence ST25.txt", created on Jun. 1, 2019 and having 80,373,218 bytes of data, machine formatted on IBM-PC, MS-Windows operating system. The sequence listing is hereby incorporated herein by reference in its entirety for all purposes.

BACKGROUND

CARs are synthetic immune-receptors, which can redirect T cells to selectively kill tumor cells. Unlike the physiologic T-cell receptor (TCR), which engages HLA-peptide complexes, CARs engage molecules that do not require peptide processing or HLA expression to be recognized. Initial first-generation CARs were constructed through the fusion of a scFv (single chain fragment variable)-based antigen binding domain to an inert CD8 transmembrane domain, linked to a cytoplasmic signaling domain derived from the CD3-ξ or Fc receptor γ chains. To overcome the lack of T-cell co-stimulation, first generation CARs were further modified by incorporating the cytoplasmic signaling domains of T-cell costimulatory receptors.

Despite the success with CAR-T cells, there are several limitations to this approach, including toxicities such as "Cytokine release syndrome" (CRS) and neurotoxicities. The inclusion of costimulatory domain in the CAR construct results in non-physiological tonic signaling through the receptor, which in turn could contribute to their toxicity and lack of persistence.

To overcome some of the design limitation of conventional 2nd generation CARs, several alternative designs, collectively termed next generation CARs, have been described, including Ab-TCR (WO 2017/070608 A1 incorporated herein by reference), TCR receptor fusion proteins or TFP (WO 2016/187349 A1 incorporated herein by reference), Synthetic Immune Receptors (SIRs) (see, WO 2018/102795 A1, incorporated herein by reference), Tri-functional T cell antigen coupler (Tri-TAC) (see, WO 2015/117229 A1, incorporated herein by reference). These alternative CAR designs, in general, lack a co-stimulatory domain.

SUMMARY

The following embodiments and aspects thereof are described and illustrated in conjunction with systems, compositions and methods which are meant to be exemplary and illustrative, not limiting in scope.

In certain embodiments, the disclosure provides compositions comprising genetically engineered effector cells (such as NK cells and T cells) that include polynucleotides that encode chimeric antigen receptors, synthetic immune receptors (SIRs) and the like that can be used on adoptive cell therapy for treatment of cancer, infectious, autoimmune and degenerative diseases.

In certain embodiments, the disclosure provides a platform of synthetic immune receptors, designated zSIRs, containing two CD3z chains. The polynucleotide sequences of the CD3z chains that can be used in the construction of zSIR are provided in, for example, SEQ ID NO: 67 and 71. The corresponding amino acid sequences are provided in SEQ ID NO: 4066 and 4070, respectively. The disclosure provides that the vL fragment of an antibody can be joined to one of the two CD3z chains and the vH fragment can be joined to the other CD3z chain. When the two such chains (e.g. vL-CD3z and vH-CD3z) are co-expressed in the same cell, the vL and vH fragments can bind their cognate antigen and transmit a T cell signal. In particular, T cells expressing such zSIR when exposed to a cell line expressing the cognate target antigen can activate NFAT signaling, induce IL2 production, promote T cell proliferation, promote T cell activation and exert cytotoxicity. The expression and activity of the zSIR can be further increased by incorporation of a linker between the vL/vH and the CD3z fragments. In particular, the IgCL (SEQ ID NO: 28 and 4027) and IgCH domains (SEQ ID NO: 29 and 4028) derived from antibodies serve as useful linkers between the vL/vH and CD3z fragments.

The disclosure further provides several new antigen binding domains that can be used in the generation of conventional CARs (e.g., 2nd generation CAR containing 41BB costimulatory domain) as well next generation CARs such as SIRs, zSIRs, Ab-TCR, Tri-TAC and TFPs, for applications in adoptive cellular therapy. In some embodiments, these antigen binding domains are derived from antibodies and target antigens expressed in both hematologic malignancies and solid tumors. The SEQ ID Nos. of vL, vH and scFv fragments of these antigen binding domains are shown in Table 3. The SEQ ID Nos of the complementary determining regions (CDRs) of the light (vL) and heavy (vH) chains are shown in Table 4. The nucleic acid and amino acid SEQ IDs of exemplary conventional CARs (i.e., $2^{nd}$ generation CARs containing 41BB costimulatory domains), and next generation CARs (e.g., SIRs, zSIRs, Ab-TCRs and TFP) based on these antigen binding domains are provided in Table 6 and 7. The CARs containing these antigen binding domains show diverse in vitro and in vivo properties, such as binding affinity to the target antigens, cytokine secretion, proliferation, cyotoxicity, exhaustion, and long term persistence. As such, the CARs containing these target antigens can be used to generate a diverse immune response. The polynucleotide, polypeptides, expression constructs, recombinantly engineered cells expressing CARs comprising the antigen binding domains of the disclosure, as well as method of making and using such polypeptides, polynucleotides and cells are described in methods known in the art and methods described in PCT/US2017/024843, WO 2014/160030 A2, WO 2016/187349 A1, PCT/US2016/058305, WO 2015/117229 A1 and PCT/US17/64379, which are incorporated herein by reference in their entirety. The immune cells expressing the CARs, both conventional and next generation CARs, comprising these antigen binding domains can be generated and used for adoptive cellular therapy of cancer, infectious and immune disorders using methods known in the art and methods described in PCT/US2017/024843, WO 2014/160030 A2, WO 2016/187349 A1, PCT/US2016/058305, WO 2015/117229 A1 and PCT/US17/64379, which are incorporated herein by reference in their entirety.

The disclosure also provides a method of improving gene transfer using lentiviral vectors by coexpressing Vif protein and a CAR (e.g., a conventional CAR, SIR, Ab-TCR, Tri-TAC or a recombinant TCR and the like) or Vif and any other therapeutic gene (e.g. β-globin gene for treatment of sickle cell anemia). An exemplary lentiviral vector (pLenti-EF1a-CD8SP-hu-CD19-USC1-LH4-vH-Gly-Ser-Linker-vL-Myc-CD8TM-BBz-2A-Vif) encoding a CAR and co-expressing Vif is provided in SEQ ID NO: 11268. In some embodiments, the Vif protein is provided in trans by co-expressing Vif in the packaging cells at the time of packaging of lentiviral vector. In such embodiment, the Vif protein is packaged along with the RNA encoding the lentiviral vector into the viral particles and is transferred to the target cells. The Vif protein can be expressed in the packaging cells by methods known in the art. In an exemplary embodiment, Vif protein is expressed in the packaging cells by co-transfecting a mammalian expression vector (e.g., pCDNA3-Vif; SEQ ID NO: 11269) encoding Vif with the lentiviral transfer vector encoding the gene(s) of interest (e.g, pLenti-EF1α-CD8SP-MYC3-WT1-Ab13-vL-V5-[hTCRb-KACIAH]-F-P2A-SP-WT1-Ab13-vH-Myc4-[hTCRa-CSDVP]-F-F2A-PAC-DWPRE; SEQ ID NO: 151) and lentiviral packaging vector(s). Exemplary lentiviral packaging vector includes pMDLg/pRRE (Addgene plasmid 12251), which is a 3rd generation lentiviral packaging plasmid encoding Gag and Pol and also requires pRSV-Rev (Addgene #12253) and envelope expressing plasmid pMD2.G (Addgene #12259) for efficient packaging. Another lentiviral packaging vector is psPAX2 (Addgene plasmid #12260), which is a 2nd generation lentiviral packaging plasmid and can be used with envelope expressing plasmid pMD2.G (Addgene #12259) to package 2nd or 3rd generation lentiviral vectors. In an exemplary embodiment, a plasmid encoding Vif can be co-transfected with psPAX2 and pMD2.G plasmids to package a 210 or a 3rd generation lentiviral vector. In an alternate exemplary embodiment, a plasmid encoding Vif can be co-transfected with pMDLg/pRRE, pRSV-Rev and pMD2.G plasmids to package a 3$^{rd}$ generation lentiviral vector. Vif can be also co-expressed from the same vector(s) encoding other lentiviral packaging proteins (e.g., gag, Pol and Rev). In an exemplary embodiment, the packaging plasmid psPAX2 is modified to also co-express Vif by methods known in the art. In an alternate exemplary embodiment, a 3rd generation lentiviral packaging plasmid encoding Gag and Pol is modified to also express Vif by fusing the nucleic acid sequence encoding Vif in frame with the nucleic acid sequence encoding Pol and separated from it by a P2A cleaveable linker sequence. In some embodiment, Vif is expressed in the packaging cells transiently while in other embodiments Vif is expressed in the packaging cells stably. In some embodiment, Vif is expressed in the target cells transiently while in other embodiments Vif is expressed in the target cells stably. In one embodiment, Vif is expressed in the target cells (e.g., T cells or stem cells) transiently by electroporation of a mammalian expression vector (e.g., pCDNA3-Vif; SEQ ID NO: 11269) encoding Vif or by electroporation of Vif polypeptide. Targe cells (e.g., T cells or stem cells) transiently expressing Vif are subsequently infected with a lentiviral vector encoding a CAR or any therapeutic gene of interest (e.g., β globin).

The polyclonal nature of the immune response is key to its success in controlling various infections. In contrast, the current CAR therapies generally rely on targeting of a single antigen and/or single epitope of a single antigen. Loss of the targeted antigen or the targeted epitope is a frequent cause of failure of the current CAR therapies. To overcome this limitation, the disclosure provides CARs against multiple antigens and against multiple epitopes of a single antigen. These CARs can be used in suitable combinations to provide a polyclonal and diverse adaptive immune response for the prevention or treatment of diseases, such as cancer, infectious diseases, autoimmune diseases, allergic diseases and degenerative diseases.

The disclosure also provides accessory modules that can be expressed in the adoptively transferred T cells (e.g., CAR-T cells, TCR-T cell and TILs) to affect their survival, proliferation, activation, effector functions (e.g., cytokines secretion, cytotoxicity etc.), exhaustion and in vivo persistence.

The disclosure provides at least one recombinant polynucleotide encoding at least one 1$^{st}$ generation or next generation chimeric antigen receptor (CAR), the at least one recombinant polynucleotide comprising: (a) a first nucleic acid domain encoding a partial or entire transmembrane and/or cytoplasmic domain and optionally the extracellular domain of an endogenous protein, wherein the endogenous protein is expressed on the surface of lymphocytes and triggers the activation and/or proliferation of the lymphocyte; (b) optionally a polynucleotide a linker; and (c) a second nucleic acid domain operably linked to the first nucleic acid domain, wherein the second nucleic acid domain encodes one or more non-natural TCR antigen binding domain(s) wherein the binding domain is selected from a binding domain set forth in Table 3; (d) an optional third nucleic acid domain encoding a costimulatory domain; and an optional additional nucleic acid domain encoding an accessory module. In one embodiment, the first nucleic acid encodes partially or entirely at least one T-cell Receptor (TCR) chain as set forth in Table 13. In another or further embodiment, the first nucleic acid encodes at least one transmembrane domain in Table 13 operably linked to the cytoplasmic domain of the TCR-type. In another or further embodiment, the polynucleotide encodes a CAR, wherein the CAR comprises: (i) a partial or entire T-cell receptor (TCR) constant chain having an amino acid sequence that has at least 75% sequence identity to a sequence selected from SEQ ID NO:4038 to 4063, 12602-12638, and which may comprise an optional costimulatory module; (ii) an optional linker; and (iii) one or more non-natural TCR antigen binding domain(s) linked to (a) selected from a binding domain set forth in Table 3; (iv) an optional accessor module; and (v) a dimer of a polypeptide comprising (i)-(iv). In another or further embodiment, the recombinant polynucleotide comprises a sequence encoding any one of the sequence in Table 2. In another or further embodiment, the accessory module comprises an amino acid sequence selected from SEQ ID NO: 4103-4117 and 4090-4096. In another or further embodiment, the encoded CAR comprises (1) any of CARs 1-16 of Table 1 and/or (2) a backbone of Table 2; and (3) a binding domain of Table 3. In another or further embodiment, (i) is a CD3z TCR constant chain. In another or further embodiment, the polynucleotide provides two first generation or next generation chimeric antigen receptors. In another or further embodiment, the polynucleotide encodes a dimer of CD3z constant chains.

The disclosure also provides at least one recombinant polynucleotide encoding at least one next generation chimeric antigen receptor (CAR), the at least one recombinant polynucleotide comprising: (a) a first nucleic acid domain encoding a partial or entire transmembrane and/or cytoplasmic domain and optionally the extracellular domain of an endogenous CD3z protein having a sequence selected from the group consisting of SEQ ID NO:4064-4066, 4070-4072, and 4075-4078, wherein the endogenous protein is expressed on the surface of lymphocytes and triggers the activation and/or proliferation of the lymphocyte; (b) optionally a polynucleotide a linker; and (c) a second nucleic acid domain operably linked to the first nucleic acid domain, wherein the second nucleic acid domain encodes one or more non-natural TCR antigen binding domain(s) wherein the binding domain is selected from a binding domain set forth in Table 3; and (d) an optional third nucleic acid domain encoding a costimulatory module; and an optional additional nucleic acid encoding an accessory module. In another or further embodiment, the nucleic acid sequences encoding the endogenous CD3z protein are selected from the group consisting of SEQ ID NO: 67 and 71. In another or further embodiment, the at least one next generation CAR comprises two CARs each CAR comprising a CD3z chain. In another or further embodiment, a vL fragment of an antibody is operably linked to one of the two CD3z chains and a vH fragment of the antibody is operably linked to the other CD3z chain. In another or further embodiment, the vL and vH chains are selected from pairs in Table 3 and 4 for a specific antigen target. In another or further embodiment, a linker is provided between the vL/vH and/or the CD3z chains. In another or further embodiment, an encoded linker is selected from the group consisting of IgCL (SEQ ID NO (DNA): 28 and SEQ ID NO (PRT): 4027) and IgCH domains (SEQ ID NO (DNA): 29 and SEQ ID NO (PRT): 4028). In another or further embodiment, further comprises the third nucleic acid domain encoding a costimulatory module. In another or further embodiment, the costimulatory module comprises a 41BB or CD28 protein. In another or further embodiment, the costimulatory module comprises an amino acid sequence selected from the group consisting of SEQ ID NO: 4067 and 4068. In another or further embodiment, the costimulatory module comprises a signaling domain from any one or more of CD134 (OX40), Dap10, CD27, CD2, CD5, ICAM-1, LFA-1, Lck, TNFR-I, TNFR-II, Fas, CD30, CD40 and combinations thereof. In another or further embodiment, further comprises the accessory module, wherein the accessory module comprises an amino acid sequence selected from SEQ ID NO: 4103-4117 and 4090-4096.

The disclosure also provides a recombinant cell expressing a homo- or hetero-dimer of a Pt generation or next generation chimeric antigen receptor (CAR), the homo- or hetero-dimer comprising: (a) a first domain encoding a partial or entire transmembrane and/or cytoplasmic domain and optionally the extracellular domain of an endogenous protein, wherein the endogenous protein is expressed on the surface of lymphocytes and triggers the activation and/or proliferation of the lymphocyte; (b) optionally a peptide linker; and (c) a second domain operably linked to the first domain, wherein the second domain comprises one or more non-natural TCR antigen binding domain(s) wherein the binding domain is selected from a binding domain set forth in Table 3; and (d) an optional third domain encoding a costimulatory module, and wherein the cell optionally comprises an accessory module, wherein the homo- or hetero-dimer associate on the surface of the recombinant cell. In another or further embodiment, the cell is transformed with the at least one recombinant polynucleotide as described herein. In another or further embodiment, the cell is a T-lymphocyte (T-cell). In another or further embodiment, the cell is a naïve T cells, a central memory T cells, an effector memory T cell, Treg or a combination thereof. In another or further embodiment, the cell is a natural killer (NK) cell, a hematopoietic stem cell (HSC), an embryonic stem cell, or a pluripotent stem cell. In another or further embodiment, the accessory module comprises an amino acid sequence selected from SEQ ID NO: 4103-4117 and 4090-4096. In another or further embodiment, the recombinant cell expresses or is engineered to express HIV1-vif.

The disclosure provides a chimeric antigen receptor (CAR) comprising (a) a first domain encoding a partial or entire transmembrane and/or cytoplasmic domain and optionally the extracellular domain of an endogenous protein, wherein the endogenous protein is expressed on the surface of lymphocytes and triggers the activation and/or proliferation of the lymphocyte; (b) optionally a peptide linker; and (c) a second domain operably linked to the first domain, wherein the second domain comprises one or more non-natural TCR antigen binding domain(s) wherein the binding domain is selected from a binding domain set forth in Table 3; and (d) an optional third domain encoding a costimulatory module. In another or further embodiment, the endogenous protein comprises a sequence selected from the group consisting of SEQ ID NO:4064-4066, 4070-4072, 4075-4078 and 12637. In another or further embodiment, the first nucleic acid encodes partially or entirely at least one T-cell Receptor (TCR) chain as set forth in Table 13. In another or further embodiment, the first comprises a transmembrane domain in Table 13 operably linked to the cytoplasmic domain of a corresponding TCR-type. In another or further embodiment, the CAR comprises: (i) a partial or entire T-cell receptor (TCR) constant chain having an amino acid sequence that has at least 75% sequence identity to a sequence selected from SEQ ID NO:4038 to 4063, 12602-12638, and which may comprise an optional costimulatory module.

The disclosure provides a polynucleotide encoding the chimeric antigen receptor as described above and herein.

The disclosure also provides a vector comprising the polynucleotide(s) described herein.

The disclosure also provides a virus comprising the polynucleotide(s) as described herein. In another or further embodiment, the virus is a retrovirus, an adenovirus, an adeno-associated virus, a lentivirus, a pox virus or a herpes virus.

The disclosure also provides a pharmaceutical composition comprising: any one or more of the inventions described herein and a pharmaceutically acceptable carrier.

The disclosure also provides a method for treating cancer comprising: providing the composition, a recombinant cell of the disclosure and administering a therapeutically effective amount of the composition or cell to the subject so as to treat cancer. In another or further embodiment, the cancer is blood cancer. In another or further embodiment, the blood cancer is any one or more of acute myeloid leukemia, chronic myeloid leukemia, myelodysplastic syndrome, lymphoma, multiple myleoma and acute lymphocytic leukemia. In another embodiment, the cancer is a solid tumor.

In one embodiment, provided herein is an isolated nucleic acid encoding a SIR (i.e., a next generation CAR), wherein the antigen specific domain of the SIR targets CD19 and the SIR optionally expresses a codon optimized variant of K13-vFLIP (K13-opt). In exemplary embodiments, the sequences of isolated nucleic acid fragments targeting CD19 are set forth in SEQ ID NOs: 14056-14059 and 14109-14112. In exemplary embodiments, the sequences of isolated polypeptide targeting CD19 and optionally coexpressing K13-vFLIP are forth in SEQ ID NOs: 15800-15803 and 15853-15856. In some embodiments, the vL and vH fragments targeting CD19 are described in Table 3 and set forth in SEQ ID Nos (DNA): 12662, 12693 and 12656 and 12687 and SEQ ID Nos (PRT): 14406, 14437 and 14400 and 14431. Also provided herein are polypeptides encoded by nucleic acids encoding SIR and optionally encoding K13-vFLIP, wherein the antigen specific domain of the SIR targets CD19. Further provided herein are vectors encoding nucleic acids encoding SIR and K13-vFLIP, wherein the antigen specific domain of the SIR targets CD19. In exemplary embodiments, a vector encoding a SIR targeting CD19 is provided in SEQ ID NO: 12641. Also provided herein are genetically engineered cells (such as T cells, NKT cells) comprising vectors encoding nucleic acids encoding SIR and K13-vFLIP, wherein the antigen specific domain of the SIR targets CD19. Also provided are methods for treatment and prevention of a disease where the disease causing or disease associated cells express CD19.

In one embodiment, provided herein is an isolated nucleic acid encoding a SIR, wherein the antigen specific domain of the SIR targets MPL and the SIR optionally expresses a codon optimized variant of K13-vFLIP (K13-opt). In exemplary embodiments, the sequences of isolated nucleic acid fragments targeting MPL are set forth in SEQ ID NOs: 13791-13792 and 13844-13845. In exemplary embodiments, the sequences of isolated polypeptide targeting MPL and optionally coexpressing K13-vFLIP are as forth in SEQ ID NOs: 15535-15536 and 15588-15589. In some embodiments, the vL and vH fragments targeting MPL are described in Table 3 and set forth in SEQ ID Nos (DNA): 12665, 12696 and 12658 and 12689 and SEQ ID Nos (PRT): 14409, 14440 and 14402 and 14433. Also provided herein are polypeptides encoded by nucleic acids encoding SIR and optionally encoding K13-vFLIP, wherein the antigen specific domain of the SIR targets MPL. Further provided herein are vectors encoding nucleic acids encoding SIR and K13-vFLIP, wherein the antigen specific domain of the SIR targets MPL. In exemplary embodiments, a vector encoding a SIR targeting MPL is provided in SEQ ID NO: 14384. Also provided herein are genetically engineered cells (such as T cells, NKT cells) comprising vectors encoding nucleic acids encoding SIR and optionally encoding K13-vFLIP, wherein the antigen specific domain of the SIR targets MPL. Also provided are methods for treatment and prevention of a disease where the disease causing or disease associated cells express MPL.

In one embodiment, provided herein is an isolated nucleic acid encoding a SIR, wherein the antigen specific domain of the SIR targets BCMA and the SIR optionally expresses a codon optimized variant of K13-vFLIP (K13-opt). In exemplary embodiments, the sequences of isolated nucleic acid fragments targeting BCMA are set forth in SEQ ID NOs: 12890-12893, 12943-12946, 12996-12999, 13049-13052 and 12837-12840. In exemplary embodiments, the sequences of isolated polypeptide targeting BCMA and optionally coexpressing K13-vFLIP are as forth in SEQ ID NOs: 14634-14637, 14687-14690, 14740-14743, 14793-14796, and 14581-14584. In some embodiments, the vL and vH fragments targeting BCMA are described in Table 3 and set forth in SEQ ID Nos (DNA): 12670 and 12701, 12669 and 12700, 12671-12702, 12657 and 12688, 12654 and 12685 and SEQ ID Nos (PRT): 14414 and 14445, 14413 and 14444, 14415 and 14446, 14398 and 14429, and 14401 and 14432. Also provided herein are polypeptides encoded by nucleic acids encoding SIR and optionally encoding K13-vFLIP, wherein the antigen specific domain of the SIR targets BCMA. Further provided herein are vectors encoding nucleic acids encoding SIR and K13-vFLIP, wherein the antigen specific domain of the SIR targets BCMA. In exemplary embodiments, vectors encoding a SIR targeting BCMA are provided in SEQ ID NO: 14378 and 14385. Also provided herein are genetically engineered cells (such as T cells, NKT cells) comprising vectors encoding nucleic acids encoding SIR and optionally encoding K13-vFLIP, wherein the antigen specific domain of the SIR targets BCMA. Also provided are methods for treatment and prevention of a disease where the disease causing or disease associated cells express BCMA.

In one embodiment, provided herein is an isolated nucleic acid encoding a SIR, wherein the antigen specific domain of the SIR targets MSLN and the SIR optionally expresses a codon optimized variant of K13-vFLIP (K13-opt). In exemplary embodiments, the sequences of isolated nucleic acid fragments targeting MSLN are set forth in SEQ ID NOs: 14268-14269, 14321-14322, and 14374-14375. In exemplary embodiments, the sequences of isolated polypeptide targeting MSLN and optionally coexpressing K13-vFLIP are as forth in SEQ ID NOs: 16012-16013, 16065-16066 and 16118-16119. In some embodiments, the vL and vH fragments targeting MSLN are described in Table 3 and set forth in SEQ ID Nos (DNA): 12668 and 12699, 12667 and 12698, and 12666-12697 and SEQ ID Nos (PRT): 14412 and 14443, 14411 and 14442, and 14410 and 14441. Also provided herein are polypeptides encoded by nucleic acids encoding SIR and optionally encoding K13-vFLIP, wherein the antigen specific domain of the SIR targets MSLN. Further provided herein are vectors encoding nucleic acids encoding SIR and K13-vFLIP, wherein the antigen specific domain of the SIR targets MSLN. In exemplary embodiments, vectors encoding a SIR targeting MSLN are provided in SEQ ID NO: 14381 and 14383. Also provided herein are genetically engineered cells (such as T cells, NKT cells) comprising vectors encoding nucleic acids encoding SIR and optionally encoding K13-vFLIP, wherein the antigen specific domain of the SIR targets MSLN. Also provided are methods for treatment and prevention of a disease where the disease causing or disease associated cells express MSLN.

In one embodiment, provided herein is an isolated nucleic acid encoding a SIR, wherein the antigen specific domain of the SIR targets CD22 and the SIR optionally expresses a codon optimized variant of K13-vFLIP (K13-opt). In exemplary embodiments, the sequences of isolated nucleic acid fragments targeting CD22 are set forth in SEQ ID NOs: 13314-13317, 13420-13423, 13473-13476 and 14215-14218. In exemplary embodiments, the sequences of isolated polypeptide targeting CD22 and optionally coexpressing K13-vFLIP are as forth in SEQ ID NOs: 15058-15061, 15164-15167, 15217-15220, and 15959-15962. In some embodiments, the vL and vH fragments targeting CD22 are described in Table 3 and set forth in SEQ ID Nos (DNA): 12663 and 12694, 12655 and 12686, 12643 and 12674, 12652 and 12683 and SEQ ID Nos (PRT): 14407 and 14438, 14399 and 14430, 14387 and 14418, 14396 and 14427. Also provided herein are polypeptides encoded by nucleic acids encoding SIR and optionally encoding K13-vFLIP, wherein the antigen specific domain of the SIR targets CD22. Further provided herein are vectors encoding nucleic acids encoding SIR and K13-vFLIP, wherein the antigen specific domain of the SIR targets CD22. In exemplary embodiments, a vector encoding a SIR targeting CD22 is provided in SEQ ID NO: 12640. Also provided herein are genetically engineered cells (such as T cells, NK cells) comprising vectors encoding nucleic acids encoding SIR and optionally encoding K13-vFLIP, wherein the antigen specific domain of the SIR targets CD22. Also provided are methods for treatment and prevention of a disease where the disease causing or disease associated cells express CD22.

DETAILED DESCRIPTION

Figure 1:
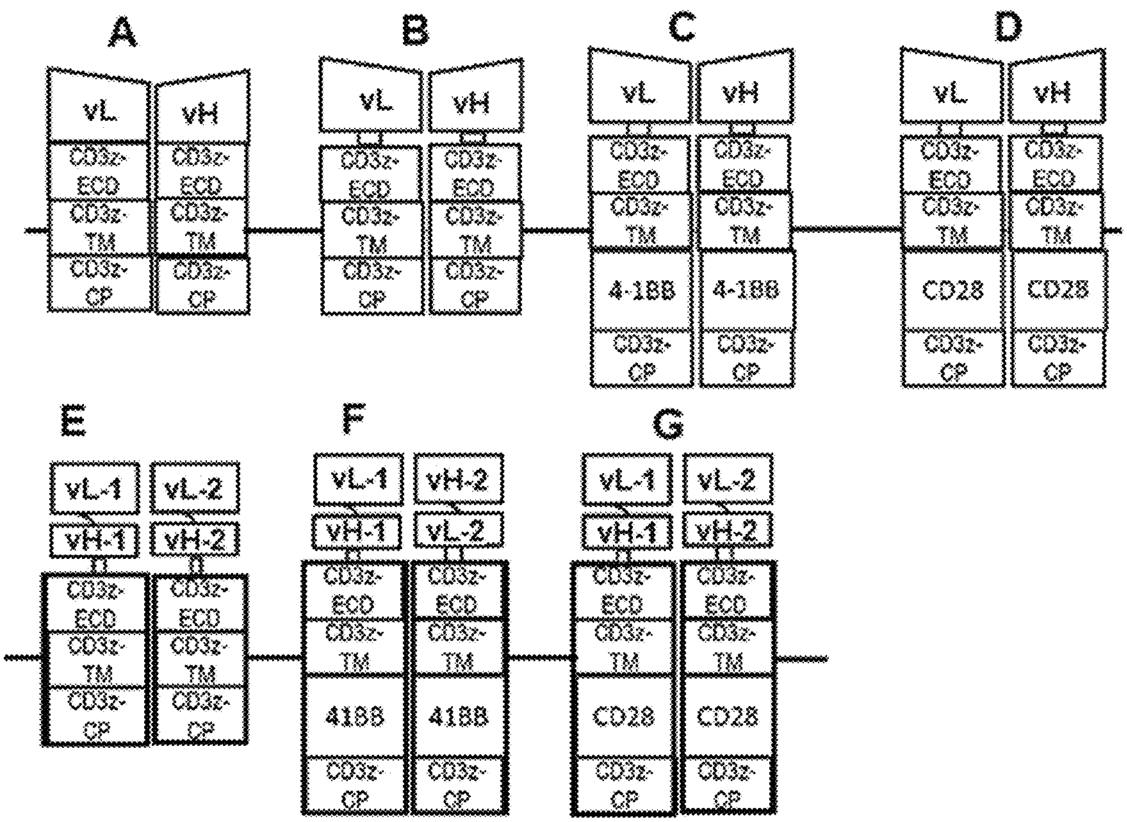
FIG. 1 depicts a schematic representation of different zSIRs. CD3z-ECD, CD3z-TM, CD3z-CP refers to the extracellular, transmembrane and cytoplasmic domains of CD3z. 4-1BB and CD28 refers to the cytoplasmic costimulatory domains of 4-1BB and CD28.

As used herein and in the appended claims, the singular forms "a," "an," and "the" include plural referents unless the context clearly dictates otherwise. Thus, for example, reference to "a cell" includes a plurality of such cells and reference to "the polynucleotide" includes reference to one or more polynucleotides and so forth.

Also, the use of "or" means "and/or" unless stated otherwise. Similarly, "comprise," "comprises," "comprising" "include," "includes," and "including" are interchangeable and not intended to be limiting.

It is to be further understood that where descriptions of various embodiments use the term "comprising," those skilled in the art would understand that in some specific instances, an embodiment can be alternatively described using language "consisting essentially of" or "consisting of."

Unless otherwise defined, all technical and scientific terms used herein have the same meaning as commonly understood by one of ordinary skill in the art to which this invention belongs.

The term "about" when referring to a measurable value such as an amount, a temporal duration, and the like, is meant to encompass variations of ±20% or in some instances ±10%, or in some instances ±5%, or in some instances ±1%, or in some instances ±0.1% from the specified value, as such variations are appropriate to perform the disclosed methods or describe the compositions herein.

The term "Ab-TCR" or "AbTCR" refers to a next generation CAR platform as described in WO 2017/070608 A1 which is incorporated herein by reference. In an embodiment, an Ab-TCR comprises an antibody moiety that specifically binds to a target antigen fused to a TCR module capable of recruiting at least one TCR signaling module. Exemplary TCR modules that can be used in the construction of Ab-TCR are provided in SEQ ID NO: 959-964 (Table 6D) of WO2019067805 and in WO 2017/070608 A1 which are incorporated herein by reference. Exemplary Ab-TCRs targeting BCMA and co-expressing an accessory module encoding NEMO-K277A are provided in SEQ ID NO: 4382-4383 (Table 6). However, the accessory module encoding NEMO-K277A is optional. Ab-TCR with the antigen binding domains (i.e., vL and vH fragments, ligands and receptors etc.) described in this disclosure can be constructed without NEMO-K277A. As such this accessory module along with the upstream Furine-SGSG-F2A sequence can be deleted from the Ab-TCR. Alternatively, the accessory module encoding NEMO-K277A can be replaced by accessory modules encoding other proteins, such as hNEMO-K277A-deltaV249-K555, mNEMO-K270A, K13-opt, IKK2-S177E-S181E, or IKK1-5176E-5180E, and MyD88-L265P, FKBPx2-NEMO, NEMO-L600-FKBPx2 etc. Furthermore, the TCR modules present in the Ab-TCR can be substituted by other TCR modules described in WO 2017/070608 A1.

The term "accessory module" refers to an element that is co-expressed with a CAR (including next generation CAR such as SIR, zSIR, Ab-TCR, Tri-TAC, TFP etc.) and/or rTCR to increase, decrease, regulate or modify the expression or activity of a CAR/rTCR or CAR/rTCR-expressing cells. Exemplary accessory modules include any one or more of 41BBL, CD40L, HIV1-Vif, vFLIP K13, MC159, cFLIP-L/MRITα, cFLIP-p22, HTLV1 Tax, HTLV2 Tax, HTLV2 Tax-RS mutant, FKBPx2-K13, FKBPx2-HTLV2-Tax, FKBPx2-HTLV2-Tax-RS, IL6R-304-vHH-Alb8-vHH, IL12f, PD1-4H1 scFV, PD1-5C4 scFV, PD1-4H1-Alb8-vHH, PD1-5C4-Alb8-vHH, CTLA4-Ipilimumab-scFv, CTLA4-Ipilimumab-Alb8-vHH, IL6-19A-scFV, IL6-19A-scFV-Alb8-vHH, sHVEM, sHVEM-Alb8-vHH, hTERT, Fx06, hNEMO-K277A, shRNA targeting Brd4 and combination thereof. The accessory module can be co-expressed with the CAR/rTCR and the like using a single vector or using two or more different vectors. In some embodiments, the accessory modules reduce or prevent toxicity associated with CARs and/of TCRs and the like. In some embodiments, the accessory module improves the efficiency of lentiviral mediated gene transfer.

The term "antibody," as used herein, refers to a protein, or polypeptide sequence derived from an immunoglobulin molecule which specifically binds with an antigen. Antibodies can be monoclonal, or polyclonal, multiple or single chain, or intact immunoglobulins, and may be derived from natural sources or from recombinant sources. Antibodies can be tetramers of immunoglobulin molecules. The antibody may be 'humanized', 'chimeric' or non-human.

The term "antibody fragment" refers to at least one portion of an antibody, that retains the ability to specifically interact with (e.g., by binding, steric hindrance, stabilizing/destabilizing, spatial distribution) an epitope of an antigen. Examples of antibody fragments include, but are not limited to, Fab, Fab', F(ab'h, Fv fragments, scFv antibody fragments, disulfide-linked Fvs (sdFv), a Fd fragment consisting of the VH and CH1 domains, linear antibodies, single domain antibodies such as sdAb (either vL or vH), camelid vHH domains, multi-specific antibodies formed from antibody fragments such as a bivalent fragment comprising two Fab fragments linked by a disulfide bridge at the hinge region, and an isolated CDR or other epitope binding fragments of an antibody. An antigen binding fragment can also be incorporated into single domain antibodies, maxibodies, minibodies, nanobodies, intrabodies, diabodies, triabodies, tetrabodies, v-NAR and bis-scFv (see, e.g., Hollinger and Hudson, Nature Biotechnology 23:1126-1136, 2005). Antigen binding fragments can also be grafted into scaffolds based on polypeptides such as a fibronectin type III (Fn3) (see U.S. Pat. No. 6,703,199, which describes fibronectin polypeptide mini bodies).

The term "antibody heavy chain," refers to the larger of the two types of polypeptide chains present in antibody molecules in their naturally occurring conformations, and which normally determines the class to which the antibody belongs.

The term "antibody light chain," refers to the smaller of the two types of polypeptide chains present in antibody molecules in their naturally occurring conformations. Kappa (κ) and lambda (λ) light chains refer to the two major antibody light chain isotypes.

The term "anticancer effect" or "anti-tumor effect" refers to a biological effect which can be manifested by various means, including, but not limited to, a decrease in tumor volume, a decrease in the number of cancer cells, a decrease in the number of metastases, an increase in life expectancy, decrease in cancer cell proliferation, decrease in cancer cell survival, or amelioration of various physiological symptoms associated with the cancerous condition. An "anticancer effect" can also be manifested by the ability of a CAR, SIR, TFP, Ab-TCR, Tri-Tac, zSIR and the like in prevention of the occurrence of cancer in the first place.

"Anticancer agent" refers to agents that inhibit aberrant cellular division and growth, inhibit migration of neoplastic cells, inhibit invasiveness or prevent cancer growth and metastasis.

The term "antigen" or "Ag" refers to a molecule that provokes an immune response.

The term "antigen presenting cell" or "APC" refers to any cell that expresses on its surface an antigen that can be recognized by an immune cell or antibody that binds to an immune cell. For example, a CD19 expressing B lymphocyte can serve as an antigen presenting cell for a T cell expressing a CAR directed against CD19. An APC may present an antigen independent of an MHC molecule or in context of an MHC molecule. The APC may present the antigen in complex with major histocompatibility complexes (MHC's). The T-cells may recognize these MHC-antigen complexes using their T-cell receptors (TCRs). In alternate embodiment, an APCs may present an antigen on its surface that is recognized by a natural (e.g., CD28 or 41BB) or a synthetic (e.g., CAR, SIR, zSIR, Ab-TCR, Tri-Tac, or TFP etc.) receptor expressed on T cells independent of MHC.

The term "antigen presenting substrate" or "APS" refers to any substrate such as a bead, a microbead, a plate, or any matrix that displays a foreign antigen on its surface. In one embodiment, an APS may present an antigen on its surface that is recognized by a natural (e.g., CD28 or 41BB) or synthetic (e.g., a conventional CAR, a SIR, a zSIR, an Ab-TCR, a TFP) receptor expressed on T cells. In an exemplary embodiment, beads coated with the extracellular domain of CD19 on their surface can serve as APS for T cells expressing a CD19-directed conventional CAR, SIR, zSIR, Ab-TCR or TFP.

The term "anti-infection effect" refers to a biological effect which can be manifested by various means, including, but not limited to, e.g., decrease in the titer of the infectious agent, a decrease in colony counts of the infectious agent, amelioration of various physiological symptoms associated with the infectious condition. An "anti-infectious effect" can also be manifested by the ability of the peptides, polynucleotides, cells and antibodies in prevention of the occurrence of infection in the first place.

As used herein "affinity" is meant to describe a measure of binding strength. Affinity, in some instances, depends on the closeness of stereochemical fit between a binding agent and its target (e.g., between an antibody and antigen including epitopes specific for the binding domain), on the size of the area of contact between them, and on the distribution of charged and hydrophobic groups. Affinity generally refers to the "ability" of the binding agent to bind its target. There are numerous ways used in the art to measure "affinity". For example, methods for calculating the affinity of an antibody for an antigen are known in the art, including use of binding experiments to calculate affinity. Binding affinity may be determined using various techniques known in the art, for example, surface plasmon resonance, bio-layer interferometry, dual polarization interferometry, static light scattering, dynamic light scattering, isothermal titration calorimetry, ELISA, analytical ultracentrifugation, and flow cytometry. An exemplary method for determining binding affinity employs surface plasmon resonance. Surface plasmon resonance is an optical phenomenon that allows for the analysis of real-time biospecific interactions by detection of alterations in protein concentrations within a biosensor matrix, for example using the BIAcore system (Pharmacia Biosensor AB, Uppsala, Sweden and Piscataway, N.J.).

An "antigen binding domain" or "antigen binding module" or "antigen binding segment" refers to a polypeptide or peptide that due to its primary, secondary or tertiary sequence and or post-translational modifications and/or charge binds to an antigen with a high degree of specificity. The antigen binding domain may be derived from different sources, for example, an antibody, a non-immunoglobulin binding protein, a ligand or a receptor.

"Avidity" refers to the strength of the interaction between a binding agent and its target (e.g., the strength of the interaction between an antibody and its antigen target, a receptor and its cognate and the like). Antibodies and affinities can be phenotypically characterized and compared using functional assays (e.g., flow cytometry assay and Topanga assay).

The term "Association constant (Ka)" is defined as the equilibrium constant association of a receptor and ligand or antibody and antigen.

The term "autoantigen" refers to an endogenous antigen that stimulates production of an autoimmune response, such as production of autoantibodies. Examples of autoantigens include, but are not limited to, desmoglein 1, desmoglein 3, and fragments thereof.

As used herein, the term "backbone" refers to the specific combination of CARs (Table 1) and accessory modules as described in Table 2. In exemplary embodiments, specific combinations of CARs and accessory modules which comprise various backbones are described in Table 2. In one embodiment, the CAR and the accessory module are encoded by a single nucleic acid molecule. In another embodiment, the CAR is encoded by the first nucleic acid molecule and the accessory module is encoded by a second nucleic acid molecule. In some embodiments, the accessory module is encoded by more than one nucleic acid molecule, depending on the number of components in the accessory modules.

As used herein "beneficial results" may include, but are in no way limited to, lessening or alleviating the severity of the disease condition, preventing the disease condition from worsening, curing the disease condition, preventing the disease condition from developing, lowering the chances of a patient developing the disease condition and prolonging a patient's life or life expectancy.

As used herein, the term "binding domain" or "antibody molecule" refers to a protein, e.g., an immunoglobulin chain or fragment thereof, comprising at least one domain, e.g., immunoglobulin variable domain sequence that can bind to a target with affinity higher than a non-specific domain. The term encompasses antibodies and antibody fragments.

"Binds the same epitope as" means the ability of an antibody, scFv, or other antigen binding domain to bind to a target antigen and having the same epitope as the exemplified antibody, scFv, or other antigen binding domain. As an example, the epitopes of the exemplified antibody, scFv, or other binding agent and other antibodies can be determined using standard epitope mapping techniques. The epitope bound by the antigen binding domain of a conventional CAR or a next generation CAR (e.g, SIR, zSIR, TFP, Tri-Tac or Ab-TCR) can be also determined by the Epitope Binning assay. Epitope binning is a competitive immunoassay used to characterize and then sort a library of monoclonal antibodies against a target protein. Antibodies against a similar target are tested against all other antibodies in the library in a pairwise fashion to see if antibodies block one another's binding to the epitope of an antigen. After each antibody has a profile created against all of the other antibodies in the library, a competitive blocking profile is created for each antibody relative to the others in the library. Closely related binning profiles indicate that the antibodies have the same or a closely related epitope and are "binned" together. Similarly, conformational epitopes are readily identified by determining spatial conformation of amino acids such as by, e.g., hydrogen/deuterium exchange, x-ray crystallography and two-dimensional nuclear magnetic resonance. See, e.g., Epitope Mapping Protocols, supra. Antigenic regions of proteins can also be identified using standard antigenicity and hydropathy plots, such as those calculated using, e.g., the Omiga version 1.0 software program available from the Oxford Molecular Group. This computer program employs the Hopp/Woods method, Hopp et al., (1981) Proc. Natl. Acad. Sci USA 78:3824-3828; for determining antigenicity profiles, and the Kyte-Doolittle technique, Kyte et al., (1982) J. Mol. Biol. 157: 1 05-132; for hydropathy plots. To determine if selected monoclonal antibodies against a target (e.g., CD19) bind to unique epitopes, each antibody can be biotinylated using commercially available reagents (Pierce, Rockford, Ill.). Competition studies using unlabeled monoclonal antibodies and biotinylated monoclonal antibodies can be performed using CD19-extracellular domain coated-ELISA plates. Biotinylated mAb binding can be detected with a strep-avidin-alkaline phosphatase probe.

As used herein, the term "CDR" or "complementarity determining region" is intended to mean the non-contiguous antigen combining sites found within the variable region of both heavy and light chain polypeptides. These particular regions have been described by Kabat et al., J. Bioi. Chem. 252:6609-6616 (1977); Kabat et al., U.S. Dept. of Health and Human Services, "Sequences of proteins of immunological interest" (1991); Chothia et al., J. Mol. Bioi. 196: 901-917 (1987); and MacCallum et al., J. Mol. Bioi. 25 262:732-745 (1996), where the definitions include overlapping or subsets of amino acid residues when compared against each other. Nevertheless, application of either definition to refer to a CDR of an antibody or grafted antibodies or variants thereof is intended to be within the scope of the term as defined and used herein. As used herein, the different CDRs of an antibody could be also defined by a combination of the different definitions. For example, vHCDR1 could be defined based on Kabat and VHCDR2 could be defined based on Chothia. The amino acid residues which encompass the CDRs as defined by each of the above cited references are as follows:

CDR DEFINITIONS

| | Kabat | Chothia | MacCallum |
|---|---|---|---|
| VHCDR1 | 31-35 | 26-32 | 30-35 |
| VHCDR2 | 50-65 | 53-55 | 47-58 |
| VHCDR3 | 95-102 | 96-10 | 193-101 |
| VLCDR1 | 24-34 | 26-32 | 30-36 |
| VLCDR2 | 50-56 | 50-52 | 46-55 |
| VLCDR3 | 89-97 | 91-96 | 89-96 |

(Residue Numbers correspond to the identified reference).

The term "framework region" refers to the art-recognized portions of an antibody variable region that exist between the more divergent (i.e., hypervariable) CDRs.

Amino acid sequence modifications of the binding molecules described herein are contemplated. For example, it may be desirable to improve the binding affinity and/or other biological properties of the vL and/or vH fragments of a conventional CAR or a next generation CAR (e.g., SIR, zSIR and the like). Such modifications include, for example, deletions from, and/or insertions into, and/or substitutions of, residues within the amino acid sequences of the binding molecules. Any combination of deletion, insertion, and substitution can be made to arrive at the final construct, provided that the final construct possesses the desired characteristics. The amino acid changes also may alter post-translational processes of the binding molecules, such as changing the number or position of glycosylation sites. Preferably, 1, 2, 3, 4, 5, 6, 7, 8, 9, or 10 amino acids may be substituted in a CDR, while 1, 2, 3, 4, 5, 6, 7, 8, 9, 10, 11, 12, 13, 14, 15, 16, 17, 18, 19, 20, or 25 amino acids may be substituted in the framework regions (FRs). The substitutions are preferably conservative substitutions as described herein. Additionally, or alternatively, 1, 2, 3, 4, 5, or 6 amino acids may be inserted or deleted in each of the CDRs (of course, dependent on their length), while 1, 2, 3, 4, 5, 6, 7, 8, 9, 10, 11, 12, 13, 14, 15, 16, 17, 18, 19, 20, or 25 amino acids may be inserted or deleted in each of the FRs.

Preferably, amino acid sequence insertions include amino- and/or carboxyl-terminal fusions ranging in length from 1, 2, 3, 4, 5, 6, 7, 8, 9 or 10 residues to polypeptides containing a hundred or more residues, as well as intrasequence insertions of single or multiple amino acid residues. An insertional variant of the binding molecule includes the fusion to the N- or C-terminus of the antibody to an enzyme or a fusion to a polypeptide which increases the serum half-life of the antibody.

Another type of variant is an amino acid substitution variant. These variants have preferably at least 1, 2, 3, 4, 5, 6, 7, 8, 9 or 10 amino acid residues in the binding molecule replaced by a different residue. The sites of greatest interest for substitutional mutagenesis include the CDRs of the heavy and/or light chain, in particular the hypervariable regions, but FR alterations in the heavy and/or light chain are also contemplated.

For example, if a CDR sequence encompasses 6 amino acids, it is envisaged that one, two or three of these amino acids are substituted. Similarly, if a CDR sequence encompasses 15 amino acids it is envisaged that one, two, three, four, five or six of these amino acids are substituted.

Generally, if amino acids are substituted in one or more or all of the CDRs of the heavy and/or light chain, it is preferred that the then-obtained "substituted" sequence is at least 60%, more preferably 65%, even more preferably 70%, particularly preferably 75%, more particularly preferably 80% identical to the "original" CDR sequence. This means that it is dependent of the length of the CDR to which degree it is identical to the "substituted" sequence. For example, a CDR having 5 amino acids is preferably 80% identical to its substituted sequence in order to have at least one amino acid substituted. Accordingly, the CDRs of the binding molecule may have different degrees of identity to their substituted sequences, e.g., CDRL1 may have 80%, while CDRL3 may have 90%.

Preferred substitutions (or replacements) are conservative substitutions. However, any substitution (including non-conservative substitution or one or more from the "exemplary substitutions" listed herein below) is envisaged as long as the binding molecule retains its capability to bind to the target antigen and/or its CDRs have an identity to the then substituted sequence (at least 60%, more than 65%, more than 70%, typically more than 75%, or more than 80% identical to the "original" CDR sequence).

Non-conservative substitutions will entail exchanging a member of one for another class. Any cysteine residue not involved in maintaining the proper conformation of the binding molecule may be substituted, generally with serine, to improve the oxidative stability of the molecule and prevent aberrant crosslinking. Conversely, cysteine bond(s) may be added to the antibody to improve its stability (particularly where the antibody is an antibody fragment such as an Fv fragment).

The SEQ IDs of the CDRs of the exemplary vL and vH segments that can be used to constitute the antigen binding domains of a CAR (e.g., a $2^{nd}$ generation CAR, a SIR, a zSIR, an Ab-TCR, Tri-Tac or a TFP) of the disclosure targeting different antigens are provided in Table 4.

In some embodiments, reference to an antigen-binding module (such as a Fab-like or Fv-like antigen-binding module) that specifically binds to a target antigen means that the antigen-binding module binds to the target antigen with (a) an affinity that is at least about 10 (e.g., about 10, 20, 30, 40, 50, 75, 100, 200, 300, 400, 500, 750, 1000 or more) times its binding affinity for other molecules; or (b) a $K_d$ no more than about 1/10 (e.g., 1/10, 1/20, 1/30, 1/40, 1/50, 1175, 1/100, 1/200, 1/300, 1/400, 1/500, 1/750, 1/1000 or less) times its $K_d$ for binding to other molecules. Binding affinity can be determined by methods known in the art, such as ELISA, fluorescence activated cell sorting (FACS) analysis, or radioimmunoprecipitation assay (RIA). $K_d$ can be determined by methods known in the art, such as surface plasmon resonance (SPR) assay utilizing, for example, Biacore instruments, or kinetic exclusion assay (KinExA) utilizing, for example, Sapidyne instruments.

"Cancer" and "cancerous" refer to or describe the physiological condition in mammals that is typically characterized by unregulated cell growth. Examples of cancer include, but are not limited to B-cell lymphomas (Hodgkin's lymphomas and/or non-Hodgkins lymphomas), testicular cancer, lung cancer, and leukemia. Other cancer and cell proliferative disorders will be readily recognized in the art. The terms "tumor" and "cancer" are used interchangeably herein, e.g., both terms encompass solid and liquid, e.g., diffuse or circulating, tumors. As used herein, the term "cancer" or "tumor" includes premalignant, as well as malignant cancers and tumors.

"Chemotherapeutic agents" are compounds that are known to be of use in chemotherapy for cancer.

"Chimeric antigen receptors" (CAR) are artificial T cell receptors contemplated for use as a therapy for cancer, using a technique called adoptive cell transfer. CARs are constructed specifically to stimulate T cell activation and proliferation in response to a specific antigen to which the CAR binds. The term "Chimeric Antigen Receptor" or alternatively a "CAR" refers to a set of polypeptides, typically two in the simplest embodiments, which when expressed in an immune effector cell, provides the cell with specificity for a target cell, typically a cancer cell, and with intracellular signal generation. In some embodiments, a CAR comprises at least an extracellular antigen binding domain, a transmembrane domain and a cytoplasmic signaling domain (also referred to herein as "an intracellular signaling domain") comprising a functional signaling domain derived from a stimulatory molecule and/or costimulatory molecule. In some aspects, the set of polypeptides are contiguous with each other. In one aspect, the stimulatory molecule is the zeta chain associated with the T cell receptor complex. In one aspect, the cytoplasmic signaling domain further comprises one or more functional signaling domains derived from at least one costimulatory molecule as defined below. In one aspect, the costimulatory molecule is chosen from the costimulatory molecules described herein, e.g., 4-1BB (i.e., CD137), CD27 and/or CD28. In one aspect the CAR comprises an optional leader sequence at the amino-terminus (N-ter) of the CAR fusion protein. In one aspect, the CAR further comprises a leader sequence at the N-terminus of the extracellular antigen binding domain, wherein the leader sequence is optionally cleaved from the antigen binding domain (e.g., a scFv) during cellular processing and localization of the CAR to the cellular membrane. Typically, "CAR-T cells" are used, which refer to T-cells that have been engineered to containing a chimeric antigen receptor. Thus, T lymphocytes bearing such CARs are generally referred to as CAR-T lymphocytes. A second generation CAR targeting CD19 and comprising a CD8 signal peptide, an antigen binding domain based on CD19-AM1 scFv, a CD8 hinge and transmembrane domain, a 4-1BB costimulatory domain and a CD3z stimulatory domain is represented by SEQ ID NO: 799. A CAR in which the 4-1BB costimulatory domain is replaced by a different costimulatory domain (e.g., CD28 or CD27) is also referred to as a conventional CAR. To overcome the limitation of conventional CARs, several alternative designs or next generation CARs have been described, including TCR receptor fusion proteins or TFP (WO 2016/187349 A1), antibody TCR or AbTCRs (PCT/US2016/058305). Tri-TAC (WO 2015/117229 A1) and synthetic immune receptors or SIR (U.S. 62/429,597 and PCT/US17/64379). As used herein, the term "CAR" or "CARs" also encompasses newer approaches (i.e., TFP, AbTCR, Tri-Tac, SIR and zSIR etc.) to conferring antigen specificity onto cells. The present disclosure provides several novel antigen binding domains that can be used for the generation of CARs. Although not excitedly described, it is envisioned that these antigen binding domain(s) (e.g, scFv, vL, vH, or vHH etc.) can be used to generate the conventional first and second generation CARs as well as newer approaches (i.e., TFP, AbTCR, Tri-Tac, SIR and zSIR etc.) to conferring antigen specificity onto cells. Thus, the vL and vH fragments of a given antigen binding domain can be used to generate a double chain SIR, a double chain Ab-TCR or a double chain zSIR when these fragments are fused to the two constant chains (e.g, TCRa/b or TCRg/d) comprising a SIR, Ab-TCR or zSIR. The vL and vH fragment of the same antigen binding domain can be joined via a flexible linker to generate a scFv which in turn can be used to generate a conventional first or second generation CAR, a TFP or a Tri-TAC using methods known in the art.

"Codon optimization" or "controlling for species codon bias" refers to the preferred codon usage of a particular host cell As used herein, "co-express" refers to expression of two or more genes. Genes may be nucleic acids encoding, for example, a single protein or a chimeric protein as a single polypeptide chain. For example, the zSIR described herein may be encoded by a single polynucleotide chain and synthesized as single polypeptide chain, which is subsequently cleaved into different polypeptides, each representing a distinct functional unit. In some embodiments, where the zSIR consists of two or more functional polypeptide units, the different functional units are coexpressed using one or more polynucleotide chains. In another embodiment, the different polynucleotide chains are linked by nucleic acid sequences that encode for cleavable linkers (e.g. T2A, F2A, P2A, E2A etc.). In another embodiment, a Ser-Gly-Ser-Gly (SGSG) motif (SEQ ID NO: 86-87 and 4085-86) is also added upstream of the cleavable linker sequences to enhance the efficiency of cleavage. A potential drawback of the cleavable linkers is the possibility that the small 2A tag left at the end of the N-terminal protein may affect protein function or contribute to the antigenicity of the proteins. To overcome this, in some embodiments, a furine cleavage site (RAKR) (SEQ ID NO: 88-90 and 4087-4089) is added upstream of the SGSG motifs to facilitate cleavage of the residual 2A peptide following translation. The polynucleotides encoding the different units of a zSIR may be linked by IRES (Internal Ribosomal Entry Site) sequences. Alternately, the different functional units of a zSIR are encoded by two different polynucleotides that are not linked via a linker but are instead encoded by, for example, two different vectors. The nucleic acid sequences of cleavable linkers are provided in SEQ ID NO: 80 to SEQ ID NO: 85.

It will be recognized that proteins can have identity or homology to one another and retain similar or identical functions. For example, the disclosure includes CD3z chains that have 85%, 90%, 95%, 97%, 98%, 98.5%, 99% or 99.9% identity to any of the sequences described herein while retaining the biological activity.

The term a "costimulatory molecule" refers to a cognate binding partner on a T cell that specifically binds with a costimulatory ligand, thereby mediating a costimulatory response by the T cell, such as, but not limited to, proliferation. Costimulatory molecules include, but are not limited to an MHC class I molecule, BTLA and a Toll ligand receptor, as well as OX40, CD27, CD28, CD8, ICAM-1, LFA-1 (CD11a/CD18), ICOS (CD278), and 4-1BB (CD137). Further examples of such costimulatory molecules include CD8, ICAM-1, GITR, BAFFR, HVEM (LIGHTR), SLAMF7, NKp80 (KLRF1), NKp44, NKp30, NKp46, CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, NKG2D, NKG2C, TNFR2, TRANCE/RANKL, DNAM1 (CD226), SLAMF4 (CD244, 2B4), CD84, CD96 (Tactile), CEACAM1, CRT AM, Ly9 (CD229), CD160 (BY55), PSGL1, CD100 (SEMA4D), CD69, SLAMF6 (NTB-A, Ly108), SLAM (SLAMF1, CD150, IP0-3), BLAME (SLAMF8), SELPLG (CD162), LTBR, LAT, GADS, SLP-76, PAG/Cbp, CD19a, and a ligand that specifically binds with CD83. A costimulatory intracellular signaling domain can be the intracellular portion of a costimulatory molecule. A costimulatory molecule can be represented in the following protein families: TNF receptor proteins, Immunoglobulin-like proteins, cytokine receptors, integrins, signaling lymphocytic activation molecules (SLAM proteins), and activating NK cell receptors. Examples of such molecules include CD27, CD28, 4-1BB (CD137), OX40, GITR, CD30, CD40, ICOS, BAFFR, HVEM, ICAM-1, lymphocyte function-associated antigen-1 (LFA-1), CD2, CD8, CD7, CD287, LIGHT, NKG2C, NKG2D, SLAMF7, NKp80, NKp30, NKp44, NKp46, CD160, B7-H3, and a ligand that specifically binds with CD83, and the like. The intracellular signaling domain can comprise the entire intracellular portion, or the entire native intracellular signaling domain, of the molecule from which it is derived, or a functional fragment or derivative thereof.

The term "disease-specific antigen" or "disease-associated antigen" or "disease causing antigen" refers to an antigen expressed on cells that contribute to the development of a disease.

The term "disease-causing cell" or "disease-associated cell" refers to a cell that contribute to the development of a disease. Exemplary disease causing cells include cancer cells and virally infected cells. Non-cancerous cells, such as B lymphocytes and T lymphocytes, have been associated with the pathogenesis of immune, allergy, degenerative and infectious diseases and are also considered disease causing cells.

The term "disease-supporting antigen" refers to an antigen expressed on cells that support the survival, proliferation, persistence or activity of disease causing cells. In some embodiments, the disease-supporting antigen is an antigen present on stromal cells. Without wishing to be bound by theory, in some embodiments, the CAR-expressing cells destroy the disease-supporting cells, thereby indirectly blocking growth or survival of disease causing cells. Exemplary stromal cell antigens include bone marrow stromal cell antigen 2 (BST2), fibroblast activation protein (FAP) and tenascin.

The term "degenerative disorders" refers to a disease that is the result of a continuous process based on degenerative cell changes, affecting tissues or organs, which will increasingly deteriorate over time, whether due to normal bodily wear or lifestyle choices such as exercise or eating habits. Exemplary degenerative diseases include Alzheimer's disease, Charcot-Marie-Tooth disease, Creutzfeldt-Jakob disease, Friedreich's ataxia, Diabetes mellitus (type II), and Atherosclerosis.

"Derived from" as that term is used herein, indicates a relationship between a first and a second molecule. It generally refers to structural similarity between the first molecule and a second molecule and does not connotate or include a process or source limitation on a first molecule that is derived from a second molecule. For example, in the case of an antigen binding domain that is derived from an antibody molecule, the antigen binding domain retains sufficient antibody structure such that is has the required function, namely, the ability to bind to an antigen.

The phrase "disease associated with expression of a target antigen" or "disease associated antigen" includes, but is not limited to, a disease associated with expression of a target antigen as described herein or condition associated with cells which express a target antigen as described herein including, e.g., proliferative diseases such as a cancer or malignancy or a precancerous condition such as a myelodysplasia, a myelodysplastic syndrome or a pre leukemia; or a noncancer related indication associated with cells which express a target antigen as described herein. In one aspect, a cancer associated with expression of a tumor antigen as described herein is a hematological cancer. In one aspect, a cancer associated with expression of a tumor antigen as described herein is a solid cancer. Further diseases associated with expression of a tumor antigen described herein include, but are not limited to, atypical and/or non-classical cancers, malignancies, precancerous conditions or proliferative diseases associated with expression of a tumor antigen as described herein. Non-cancer related indications associated with expression of a target antigen as described herein include, but are not limited to, e.g., autoimmune disease, (e.g., lupus), inflammatory disorders (allergy and asthma) and transplantation. In some embodiments, the target antigen-expressing cells express, or at any time expressed, mRNA encoding the target antigen. In another embodiment, the target antigen-expressing cells produce the target antigen protein (e.g., wild-type or mutant), and the target antigen protein may be present at normal levels or reduced levels. In another embodiment, the target antigen-expressing cells produced detectable levels of a target antigen protein at one point, and subsequently produced substantially no detectable target antigen protein.

"Disease targeted by genetically modified cells" as used herein encompasses the targeting of any cell involved in any manner in any disease by a genetically modified cells that hones to the disease or a target tissue or cell type, irrespective of whether the genetically modified cells target diseased cells or healthy cells to effectuate a therapeutically beneficial result.

The term "Dissociation constant (Kd)" is defined as the equilibrium constant of the dissociation of a receptor-ligand interaction.

The term "encoding" refers to the inherent property of specific sequences of nucleotides in a polynucleotide, such as a gene, a cDNA, or an mRNA, to serve as templates for synthesis of other polymers and macromolecules in biological processes having either a defined sequence of nucleotides (e.g., rRNA, tRNA and mRNA) or a defined sequence of amino acids and the biological properties resulting therefrom. Thus, a gene, cDNA, or RNA, encodes a protein if transcription and translation of mRNA corresponding to that gene produces the protein in a cell or other biological system. Both the coding strand, the nucleotide sequence of which is identical to the mRNA sequence and is usually provided in sequence listings, and the non-coding strand, used as the template for transcription of a gene or cDNA, can be referred to as encoding the protein or other product of that gene or cDNA.

Unless otherwise specified, a "nucleotide sequence encoding an amino acid sequence" includes all nucleotide sequences that are degenerate versions of each other and that encode the same amino acid sequence. The phrase nucleotide sequence that encodes a protein or a RNA may also include in trans to the extent that the nucleotide sequence encoding the protein may in some version contain an intron(s).

The term "effective amount" or "therapeutically effective amount" are used interchangeably herein, and refer to an amount of a compound, formulation, material, or composition, as described herein effective to achieve a particular biological result.

The term "endogenous", "native" or "naturally occurring" refers to any material from or produced inside an organism, cell, tissue or system. It also refers to a gene, protein, nucleic acid (e.g., DNA, RNA etc.) or fragment thereof that is native to a cell or is naturally expressed in a cell.

The term "exogenous" refers to any material introduced from or produced outside an organism, cell, tissue or system.

The term "expression" refers to the transcription and/or translation of a particular nucleotide sequence driven by a promoter and/or other regulatory elements.

The term "transfer vector" refers to a composition of matter which comprises an isolated nucleic acid and which can be used to deliver the isolated nucleic acid to the interior of a cell. Thus, the term "transfer vector" includes an autonomously replicating plasmid or a virus. The term should also be construed to further include non-plasmid and non-viral compounds which facilitate transfer of nucleic acid into cells, such as, for example, a polylysine compound, liposome, and the like. Examples of viral transfer vectors include, but are not limited to, adenoviral vectors, adeno-associated virus vectors, retroviral vectors, lentiviral vectors, and the like.

Expression vectors include all those known in the art, including cosmids, plasmids (e.g., naked or contained in liposomes) and viruses (e.g., lentiviruses, retroviruses, adenoviruses, and adeno-associated viruses) that incorporate the recombinant polynucleotide.

As used herein, an "epitope" is defined to be the portion of an antigen capable of eliciting an immune response, or the portion of an antigen that binds to an antibody or antibody fragment. Epitopes can be a protein sequence or subsequence.

The term "expression vector" refers to a vector comprising a recombinant polynucleotide comprising expression control sequences operatively linked to a nucleotide sequence to be expressed. Expression vectors include all those known in the art, including cosmids, plasmids (e.g., naked or contained in liposomes) and viruses (e.g., lentiviruses, retroviruses, adenoviruses, and adeno-associated viruses) that incorporate the recombinant polynucleotide.

The term "functional polypeptide unit (FPU)" of, e.g., a zSIR, refers to a polypeptide comprising an amino terminal signal sequence functionally linked to an antigen binding domain and, e.g., a CD3z chain. For example, the antigen binding domain is located between the signal sequence and the CD3z chain.

The term "functional portion" when used in reference to, e.g., a zSIR refers to any part or fragment of a polypeptide, e.g., the zSIR, which part or fragment retains the biological activity of the desired molecule, e.g., of the zSIR, of which it is a part (e.e., the parent zSIR). For example, functional portions encompass those parts of a zSIR that retain the ability to recognize target cells, or detect, treat, or prevent a disease, to a similar extent, the same extent, or to a higher extent, as the parent zSIR. In reference to the parent zSIR, the functional portion can comprise, for instance, about 10%, 25%, 30%, 50%, 68%, 80%, 90%, 95%, or more, of the parent zSIR.

"Genetically modified cells", "redirected cells", "genetically engineered cells" or "modified cells" as used herein refer to cells that have been modified to express a CAR (e.g., a conventional 2nd generation CAR, TFP, AbTCR, SIR, Tri-Tac and zSIR), or a recombinant TCR. For example, a genetically modified T-lymphocyte that expresses a CAR or a zSIR is a genetically modified cell.

The term "immune disorder" refers to a disease characterized by dysfunction of immune system. An autoimmune disease is a condition arising from an abnormal immune response to a normal body part. There are at least 80 types of autoimmune diseases.

"Immune effector cell," as that term is used herein, refers to a cell that is involved in an immune response, e.g., in the promotion of an immune effector response. Examples of immune effector cells include T cells, e.g., alpha/beta T cells and gamma/delta T cells, B cells, and natural killer T (NKT) cells.

"Immune receptor expressing cell" as that term is used herein, refers to a cell that is involved in an immune response, e.g., in the promotion of an immune effector response and expresses one or more immune receptors, such as, for example, an endogenous TCR, a recombinant TCR or a CAR. Examples of immune receptor expressing cells include T cells, e.g., alpha/beta T cells and gamma/delta T cells and NKT cells.

"Immune effector function or immune effector response," as that term is used herein, refers to function or response, e.g., of an immune effector cell, that enhances or promotes an immune attack of a target cell, e.g., an immune effector function or response refers a property of a T or NK cell that promotes killing or the inhibition of growth or proliferation, of a target cell. In the case of a T cell, primary stimulation and co-stimulation are examples of immune effector function or response.

An "intracellular signaling domain," as the term is used herein, refers to an intracellular signaling portion of a molecule. The intracellular signaling domain generates a signal that promotes, for example, an immune effector function of the CAR (e.g., 2nd generation CAR, TFP, AbTCR, SIR, Tri-TAC and/or zSIR) containing cell. Examples of immune effector function include cytolytic activity and helper activity, including the secretion of cytokines. The TCRα/β/γ/δ chains do not have an intracellular signaling domain of their own but transmit a signal by associating with other chains of the TCR signaling complex (e.g., CD3z, CD3e, CD3d and CD3g) that possess a signaling domain. In another embodiment, the intracellular signaling domain can comprise a primary intracellular signaling domain. Exemplary primary intracellular signaling domains include those derived from the molecules responsible for primary stimulation, or antigen dependent simulation. In another embodiment, the intracellular signaling domain can comprise a costimulatory intracellular domain. Exemplary costimulatory intracellular signaling domains include those derived from molecules responsible for costimulatory signals, or antigen independent stimulation. For example, a primary intracellular signaling domain can comprise a cytoplasmic sequence of CD3z, and a costimulatory intracellular signaling domain can comprise cytoplasmic sequence from co-receptor or costimulatory molecule, such as CD28 or 41BB.

A primary intracellular signaling domain can comprise a signaling motif which is known as an immunoreceptor tyrosine-based activation motif or ITAM. Examples of ITAM containing primary cytoplasmic signaling sequences include, but are not limited to, those derived from CD3 zeta, common FeR gamma (FCER1G), Fe gamma RIIa, FeR beta (Fe Epsilon Rib), CD3 gamma, CD3 delta, CD3 epsilon, CD79a, CD79b, DAP1O, and DAP12.

As used herein, the term "linker" (also "linker domain" or "linker region") refers to an oligo or polypeptide that joins together two or more domains or regions of a CAR (e.g., $2^{nd}$ generation CAR, TFP, AbTCR, SIR and zSIR) disclosed herein. The linker can be anywhere from 1 to 500 amino acids in length. In some embodiments the "linker" is cleavable or non-cleavable. Unless specified otherwise, the term "linker" used herein means a non-cleavable linker. Non-cleavable linkers may be composed of flexible residues which allow freedom of motion of adjacent protein domains relative to one another. Non-limiting examples of such residues include glycine and serine. In some embodiments, linkers include non-flexible residues. Exemplary embodiments of linkers with non-flexible linkers are EAAAK (SEQ ID NO: 4011), *E-coli* (SEQ ID NO: 4009), K-coil (SEQ ID NO: 4010), or PG4SP (SEQ ID NO:4007). In other embodiments, the linker joining the antigen binding domain and the CD3z chains of a zSIR share similar length. In other embodiments, the linker joining the antigen binding domain and the CD3z chains of a zSIR differ in length by no more than 20 amino acids, typically by no more than 10 amino acids, preferably by no more than 5 amino acids, more preferably by no more than 2 amino acids. In some embodiments, the linker joining the antigen binding domain and the CD3z chains of a zSIR have the identical or similar amino acid composition. Exemplary linkers with identical composition are PG4SP (SEQ ID NO: 4007) and PG4SP-v2 (SEQ ID NO: 4008). In some embodiments, the linkers joining the antigen binding domain and the CD3z chains of a zSIR are PG4SP (DNA SEQ ID NO: 8; PRT SEQ ID NO: 4007) and PG4SP-v2 (DNA SEQ ID NO: 9; PRT SEQ ID NO: 4008).

In some embodiments, the linkers joining the antigen binding domains and the CD3z chains of a zSIR are derived from antibodies. In one embodiment, the linker joining a vL region and a CD3z chain of a zSIR is IgCL (DNA SEQ ID NO: 28; PRT SEQ ID NO: 4027) and the linker joining a vH region and a CD3z chain of a zSIR is IgG1-CH1 (DNA SEQ ID NO: 29 and PRT SEQ ID NO: 4028). In some embodiments, the linker joining the respective antigen binding domain and the CD3z chain of a zSIR are IgCL (DNA SEQ ID NO: 28; PRT SEQ ID NO: 4027) and IgG2-0C-CH1 (DNA SEQ ID NO: 30; PRT SEQ ID NO: 4029). In some embodiments, the linker may comprise an epitope tag. In some embodiments, the epitope tag is selected from the group consisting of a MYC tag, a V5 tag, a AcV5 tag, a StreptagII, a FLAG tag, or HA. In some embodiments, the non-cleavable linker is of a length sufficient to ensure that two adjacent domains do not sterically interfere with one another. In one embodiment of the disclosure, three amino acid residues (Gly-Ser-Gly) are added to the carboxy-terminal of the linkers (e.g., Myc tag or V5 tag) that are located between the antigen binding domain and the CD3z chains of the zSIR. In certain embodiments, the linkers may carry additional sequences, such as restriction enzyme sites.

The term "flexible polypeptide linker" as used in refers to a peptide linker that consists of amino acids such as, for example, glycine and/or serine residues used alone or in combination, to link polypeptide chains together (e.g., variable heavy and variable light chain regions together). In one embodiment, the flexible polypeptide linker is a Gly/Ser linker and comprises the amino acid sequence $(Gly-Gly-Gly-Ser)_n$, where n is a positive integer equal to or greater than 1. For example, n=1, n=2, n=3, n=4, n=5 and n=6, n=7, n=8, n=9 and n=10. In one embodiment, the flexible polypeptide linkers include, but are not limited to, $(Gly_4Ser)_4$ or $(Gly_4Ser)_3$ (SEQ ID NO:5). In another embodiment, the linkers include multiple repeats of $(Gly_2Ser)$, (GlySer) or $(Gly_3Ser)$. Also included within the scope of the disclosure are linkers described in WO2012/138475 (incorporated herein by reference).

The term "lentivirus" refers to a genus of the Retroviridae family. HIV, SIV, and FIV are all examples of lenti viruses.

The term "lentiviral vector" refers to a vector derived from at least a portion of a lentivirus genome, including especially a self-inactivating lentiviral vector as provided in Milone et al., Mol. Ther. 17(8): 1453-1464 (2009). Other examples of lentivirus vectors that may be used in the clinic, include but are not limited to, e.g., the LENTIVECTOR® gene delivery technology from Oxford BioMedica, the LENTIMAX™ vector system from Lentigen and the like. Other examples of lentivirus vectors are pLENTI-EF1α (SEQ ID NO: 129), pLENTI-EF1α-DWPRE (SEQ ID NO: 130) and pCCLc-MNDU3 (SEQ ID NO: 12639).

As used herein a "non-naturally occurring TCR antigen binding domain" refers to a binding domain operably linked to a TCR constant region or a CD3z chain that is chimeric and non-naturally occurring with respect to a TCR present in nature. Stated another way, the non-naturally occurring TCR antigen binding domain is "engineered" using recombinant molecular biology techniques to be operably linked to a TCR constant chain or a CD3z chain and moreover, that the antigen binding domain is obtain or derived from a molecule that is distinct from a TCR found in nature. An antigen binding domain that is distinct from a TCR in nature includes antibody vH and vL fragments, humanized antibody fragments, chimeric antibody fragments, receptor ligands, and the like.

The term "operably linked" refers to functional linkage or association between a first component and a second component such that each component can be functional. For example, operably linked includes the association between a regulatory sequence and a heterologous nucleic acid sequence resulting in expression of the latter. For example, a first nucleic acid sequence is operably linked with a second nucleic acid sequence when the first nucleic acid sequence is placed in a functional relationship with the second nucleic acid sequence. In the context of two polypeptides that are operably linked a first polypeptide functions in the manner it would independent of any linkage and the second polypeptide functions as it would absent a linkage between the two.

"Percent identity" in the context of two or more nucleic acids or polypeptide sequences, refers to two or more sequences that are the same. Two sequences are "substantially identical" if two sequences have a specified percentage of amino acid residues or nucleotides that are the same (e.g., 60% identity, optionally 70%, 71%. 72%. 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identity over a specified region, or, when not specified, over the entire sequence), when compared and aligned for maximum correspondence over a comparison window, or designated region as measured using one of the following sequence comparison algorithms or by manual alignment and visual inspection. Optionally, the identity exists over a region that is at least about 50 nucleotides (or 10 amino acids) in length, or more preferably over a region that is 100 to 500 or 1000 or more nucleotides (or 20, 50, 200 or more amino acids) in length.

The term "polynucleotide", "nucleic acid", or "recombinant nucleic acid" refers to polymers of nucleotides such as deoxyribonucleic acid (DNA), and, where appropriate, ribonucleic acid (RNA).

A "protein" or "polypeptide", which terms are used interchangeably herein, comprises one or more chains of chemical building blocks called amino acids that are linked together by chemical bonds called peptide bonds to form a polymer of amino acids.

"Refractory" as used herein refers to a disease, e.g., cancer, that does not respond to a treatment. In embodiments, a refractory cancer can be resistant to a treatment before or at the beginning of the treatment. In other embodiments, the refractory cancer can become resistant during a treatment. A refractory cancer is also called a resistant cancer.

"Relapsed" as used herein refers to the return of a disease (e.g., cancer) or the signs and symptoms of a disease such as cancer after a period of improvement, e.g., after prior treatment of a therapy, e.g., cancer therapy Ranges: throughout this disclosure, various aspects of the invention can be presented in a range format. It should be understood that the description in range format is merely for convenience and brevity and should not be construed as an inflexible limitation on the scope of the invention.

The term "retrovirus vector" or "retroviral vector" refers to a vector derived from at least a portion of a retrovirus genome. Examples of retrovirus vector include MSCVneo, MSCV-pac (or MSCV-puro), MSCV-hygro as available from Addgene or Clontech. Other example of a retrovirus vector is MSCV-Bg12-AvrII-Bam-EcoR1-Xho-BstB1-Mlu-Sal-ClaI.I03 (SEQ ID NO: 131).

The term "Sleeping Beauty Transposon" or "Sleeping Beauty Transposon Vector" refers to a vector derived from at least a portion of a Sleeping Beauty Transposon genome. An example of a Sleeping Beauty Transposon Vector is pSBbi-Pur (SEQ ID NO: 133). Other examples of Sleeping Beauty Transposon Vectors encoding a SIR are provided in SEQ ID NO: 134 and SEQ ID NO: 135.

The term "scFv" refers to a fusion protein comprising at least one antibody fragment comprising a variable region of a light chain and at least one antibody fragment comprising a variable region of a heavy chain, wherein the light and heavy chain variable regions are contiguously linked, e.g., via a synthetic linker, e.g., a short flexible polypeptide linker, and capable of being expressed as a single chain polypeptide, and wherein the scFv retains the specificity of the intact antibody from which it is derived. Unless specified, as used herein an scFv may have the vL and vH variable regions in either order, e.g., with respect to the N-terminal and C-terminal ends of the polypeptide, the scFv may comprise vL-linker-vH or may comprise vH-linker-vL. In this disclosure, a scFv is also described as vL-Gly-Ser-Linker-vH. For example, FMC63-vL-Gly-Ser-Linker-FMC63-vH refers to a scFv containing the vL and vH fragments of FMC63 monoclonal antibody linked via a linker consisting of Gly and Ser residues. Alternatively, a scFv is also described as (vL+vH). For example, FMC6-(vL+vH) refers to an scFv containing the vL and vH fragments of FMC63 antibody linked via a linker in which the vL fragment is located at the N-terminal.

The term "signaling domain" refers to the functional region of a protein which transmits information within the cell to regulate cellular activity via defined signaling pathways by generating second messengers or functioning as effectors by responding to such messengers.

The term "Synthetic Immune Receptor" or alternatively a "SIR" refers to a polypeptide, typically two polypeptides (e.g., a hetero- or homo-dimer) in some embodiments, which when expressed in an effector cell, provides the cell with specificity for a target cell, typically a cancer cell, and with intracellular signal generation. SIR have been described in PCT/US17/64379. In a typical embodiment, a SIR comprises one or more antigen binding domains (e.g., antibody or antibody fragment, a ligand or a receptor) that bind to and antigens or ligand cognate as described herein, and are joined to one or more T cell receptor constant chains or regions via an optional linker. In some embodiments, the set of polypeptides are contiguous with each other. In some embodiments, a SIR comprises two or more sets of two or more polypeptides. The polypeptides of each set of SIR are contiguous with each other (functional polypeptide unit 1) but are not contiguous with the polypeptides of the other set (functional polypeptide unit 2). In some aspects, the T cell receptor constant chains (or regions) of the SIR is chosen from the constant chain of human T cell receptor-alpha (TCR-alpha or TCRα or TCRα or hTCR-alpha or hTCRα or hTCRα or Cα), human T cell receptor-beta1 (TCR-beta1 or TCRβ1 or TCRb1 or hTCR-beta1 or hTCRβ1 or hTCRb1 or Cβ1), human T cell receptor-beta 2 (TCR-beta2 or TCRβ2 or TCRb2 or hTCR-beta2 or hTCRβ2 or hTCRb2 or Cβ2 also designated TCR-beta, TCRβ or TCRb or Cβ), human Pre-T cell receptor alpha ((preTCR-alpha or preTCRα or preTCRα or preCa), human T cell receptor-gamma (TCR-gamma or TCRγ or TCRg or hTCR-gamma or hTCRγ or hTCRg or hTCRγ1 or hTCRgamma1, or Cγ), or human T cell receptor-delta (TCR-delta or TCRd or TCRδ or hTCR-delta or hTCRd or hTCRδ or Cδ). In some embodiments, the TCR constant chains of SIR are encoded by their wild-type nucleotide sequences while in other aspects the TCR constant chains of SIR are encoded by the nucleotide sequences that are not wild-type. In some embodiments, the TCR constant chains of SIR are encoded by their codon optimized sequences. In some embodiments, the TCR constant chains of SIR encode for the wild-type polypeptide sequences while in other embodiments the TCR constant chains of SIR encoded for polypeptides that carry one or more mutations. In some embodiments, the TCR constant chains of SIR are encoded by their codon optimized sequences that carry one or more mutations. A SIR that comprises an antigen binding domain (e.g., a scFv, or vHH) that targets a specific tumor maker "X", such as those described herein, is also referred to as X-SIR or XSIR. For example, a SIR that comprises an antigen binding domain that targets CD19 is referred to as CD19-SIR or CD19SIR. The TCR constant chain/domain of a SIR can be derived from the same species in which the SIR will ultimately be used. For example, for use in humans, it may be beneficial for the TCR constant chain of the SIR to be derived from or comprised of human TCR constant chains. However, in some instances, it is beneficial for the TCR constant chain to be derived from the same species in which the SIR will ultimately be used in, but modified to carry amino acid substitutions that enhance the expression of the TCR constant chains. For example, for use in humans, it may be beneficial for the TCR constant chain of the SIR to be derived from or comprised of human TCR constant chains but in which certain amino acids are replaced by the corresponding amino acids from the murine TCR constant chains. Such "murinized" TCR constant chains provide increased expression of the SIR. The nucleic acid sequences of exemplary TCR constant chains are provided in SEQ ID NO: 39-64 (Table 5). The amino acid sequences of exemplary TCR constant chains are provided in SEQ ID NO: 4038-4063 (Table 5). The SIR or functional portion thereof, can include additional amino acids at the amino or carboxy terminus, or at both termini, which additional amino acids are not found in the amino acid sequence of the TCR or antigen binding domain which make up the SIR. Desirably, the additional amino acids do not interfere with the biological function of the SIR or functional portion, e.g., recognize target cells, detect cancer, treat or prevent cancer, etc. More desirably, the additional amino acids enhance the biological activity, as compared to the biological activity of the parent SIR.

The term "stimulation," refers to a primary response induced by binding of a stimulatory molecule (e.g., a TCR/CD3 complex or SIR) with its cognate ligand (or target antigen in the case of a SIR) thereby mediating a signal transduction event, such as, but not limited to, signal transduction via the TCR/CD3. Stimulation can mediate altered expression of certain molecules.

The term "TCR receptor fusion proteins or TFP" refers to a next generation CAR platform as described in WO 2016/187349 A1 which is incorporated herein by reference. In an embodiment, a TFP comprises an antibody moiety that specifically binds to a target antigen fused to a TCR chain such as CD3ε, CD3γ, CD3δ, TCRα or TCRβ. Exemplary TCR chains that can be used in the construction of TFP are provided in WO 2017/070608 A1 which is incorporated herein by reference. A TFP incorporating CD3ε chain is referred to as a CD3ε TFP. A TFP incorporating CD3γ chain is referred to as a CD3γ TFP. A TFP incorporating CD30 chain is referred to as a CD3δ TFP. The TFP incorporating CD3ε, CD3γ or CD3δ chains are collectively referred to as CD3ε/γ/δ TFP. Exemplary TFPs incorporating the antigen binding domain BCMA-Am06-HL targeting BCMA described in this disclosure and co-expressing an accessory module encoding NEMO-K277A are provided in SEQ ID NO: 4384-4387 (Table 6). Exemplary TFPs incorporating different antigen binding domains described in this disclosure and co-expressing an accessory module encoding NEMO-K277A are provided in Table 7. The SEQ ID Nos, antigen binding domains and target antigens of these TFPs can be determined by referring to Table 6 as the order of the different constructs (i.e., CAR class) listed in Table 7 is the same as the order of constructs (i.e., CAR class) listed in Table 6. The accessory module encoding NEMO-K277A is optional. TFP with the antigen binding domains (i.e., vL and vH fragments, ligands and receptors etc.) described in this disclosure can be constructed without NEMO-K277A. As such, this accessory module along with the upstream Furine-SGSG-F2A sequence can be deleted from the TFPs. Alternatively, the accessory module encoding NEMO-K277A can be replaced by accessory modules encoding other signaling proteins, such as hNEMO-K277A-deltaV249-K555, mNEMO-K270A, K13-opt, IKK2-S177E-S181E, or IKK1-S176E-S180E, and MyD88-L265P, FKBPx2-NEMO, NEMO-L600-FKBPx2, and CMV-141 etc.

The term "stimulatory molecule," refers to a molecule expressed by an immune cell (e.g., T cell, NK cell, B cell) that provides the cytoplasmic signaling sequence(s) that regulate activation of the immune cell in a stimulatory way for at least some aspect of the immune cell signaling pathway.

The term "subject" is intended to include living organisms in which an immune response can be elicited (e.g., any domesticated mammals or a human).

The terms "T-cell" and "T-lymphocyte" are interchangeable and used synonymously herein. Examples include but are not limited to naïve T cells ("lymphocyte progenitors"), central memory T cells, effector memory T cells, stem memory T cells ($T_{scm}$), tissue resident T cells, α/β T cells, γ/δ T cells, iPSC-derived T cells, synthetic T cells or combinations thereof.

The term "therapeutic effect" refers to a biological effect which can be manifested by various means, including but not limited to, e.g., decrease in tumor volume, a decrease in the number of cancer cells, a decrease in colony counts of the infectious agent, amelioration of various physiological symptoms associated with a disease condition, prevention of the occurrence of disease in the first place or in the prevention of relapse of the disease.

"Treatment" and "treating," as used herein refer to both therapeutic treatment and prophylactic or preventative measures. Those in need of treatment include those already with the condition as well as those prone to have the condition or those in whom the condition is to be prevented.

The term "zeta" (or defined by the greek symbol "ζ") or alternatively "zeta chain", "CD3-zeta" or "TCR-zeta" is defined as the protein provided as GenBank Accession No. BAG36664.1, or the equivalent residues from a non-human species, e.g., mouse, rodent, monkey, ape and the like, and a "zeta stimulatory domain" or alternatively a "CD3-zeta stimulatory domain" or a "TCR-zeta stimulatory domain" is defined as the amino acid residues from the cytoplasmic domain of the zeta chain, or functional derivatives thereof, that are sufficient to functionally transmit an initial signal necessary for T cell activation. In one aspect the cytoplasmic domain of zeta comprises residues 52 through 164 of GenBank Accession No. BAG36664.1 or the equivalent residues from a non-human species, e.g., mouse, rodent, monkey, ape and the like, that are functional orthologs thereof. In one aspect, the "zeta stimulatory domain" or a "CD3-zeta stimulatory domain" is the sequence provided as DNA SEQ ID NO: 101 and PRT SEQ ID NO: 4100.

Provided herein are compositions comprising a CAR and optional one or more accessory modules and method of using same to treat diseases, including cancer. As described herein, specific combinations of CARs (Table 1) and accessory modules as described in Table 2 define a 'backbone' (Table 2).

Table 1: CAR architectures. First generation CARs (conventional CAR1 or CAR I) have an antigen specific domain (ASD), an intracellular signaling domain (ISD) (e.g. CD3z) and no costimulatory domain. The TCR fusion proteins (TFP) are next generation CARs that are described in WO 2016/187349 A1 but resemble conventional CAR1 in having an antigen specific domain (ASD) and an intracellular signaling domain. Second generation CARs (Conventional CAR 2 or CAR II) have an antigen specific domain (ASD), one costimulatory domain (e.g. 41BB or CD28) and an intracellular signaling (ISD) domain (e.g. CD3z). Third generation CARs (Conventional CAR 3 or CAR III) have an antigen specific domain (ASD), two costimulatory domains (e.g. 41BB and CD28) and an intracellular signaling (ISD) domain (e.g. CD3z). AbTCRs are duel chain receptors and have been described in PCT/US2016/058305. cTCRs are single chain, one and half, or double chain receptors consisting of antigen binding domain derived from a vL and vH fragment that are fused to a TCR constant chain and result in activation of T cell signaling. Synthetic immune receptors are next generation cTCR and are described in U.S. 62/429,597 and PCT/US017/064379. SIRs can be single chain, one and half, or double chain receptors consisting of one or more antigen binding domains that are fused to one or more TCR constant chains and result in activation of T cell signaling upon ligand-binding. zSIRs are described in this application.

The zSIRs are a novel platform of synthetic immune receptors (SIRs) containing two CD3-zeta (CD3z) chains. The nucleic acid and amino acid sequences of the CD3z chains that can be used in the construction of zSIR are provided in DNA SEQ ID Nos: 67 and 71 and PRT SEQ ID Nos: 4066 and 4072. The disclosure provides that the vL fragment of an antibody can be joined to one of the two CD3z chains and the vH fragment can be joined to the other CD3z chain. When the two such chains (e.g. vL-CD3z and vH-CD3z) are co-expressed in the same cell, the vL and vH fragments can associate together, recognize their cognate antigen or binding partner and transmit a T cell signal. In particular, T cells expressing such zSIR when exposed to a cell line expressing the target antigen can activate NFAT signaling, induce IL2 production and exert cytotoxicity. The expression and activity of the zSIR can be further increased by incorporation of a linker between the vL/vH and the CD3z fragments. In particular, the IgCL and IgCH domains derived from antibodies serve as useful linkers between the vL/vH and CD3z fragments. Exemplary linkers that can be used in construction of zSIRs are provided in SEQ ID NOs: 4004 to 4037 (Table 5). Provided in FIG. 1 are schematic examples of zSIRs contemplated by the disclosure.

For example, zSIR1, the vL fragment of an scFV is joined to one CD3z-ECD-TM-CP (extracellular, transmembrane and cytoplasmic domain) and the vH fragment joined to a second CD3zECDTMCP. An exemplary zSIR1 is provided in SEQ ID NO: 425. In zSIR2, one ASD (e.g., scFV fragment) is joined to one CD3zECDTMCP (extracellular, transmembrane and cytoplasmic domain) and the second ASD is joined to a second CD3zECDTMCP. An exemplary zSIR2 is provided in SEQ ID NO: 3961. The two ASD may target the same or different antigens or different epitopes of the same antigen. An exemplary zSIR2 in which the two ASD target two different antigens is provided in SEQ ID NO: 3962. An exemplary zSIR2 in which the two ASD target two epitopes of the same antigens is provided in SEQ ID NO: 3961. In zSIR3, the vL fragment of an scFV is joined to one CD3zECDTMCP (extracellular, transmembrane and cytoplasmic domain) via the cl linker (SEQ ID NOs: 28 and 4027) derived from an immunoglobulin and the vH fragment joined to a second CD3zECDTMCP via a CH1 linker (SEQ ID NOs: 29 and 4028). An exemplary zSIR3 is CD8-hCD19-EUK5-13-vL-IgCL-Bam-CD3zECDTMCP-opt-F-P2A-Spe-SP-Bst-hCD19-EUK5-13-vH-IgG1-CH1-KPN-CD3zECDTMCP-opt2-F-F2A-Xba-PAC (SEQ ID NO: 3955). Other linkers that can be used in the construction of a zSIR are listed in Table 5.

In another embodiment, a costimulatory domain is also incorporated in the CD3z chain(s) of a zSIR. Exemplary costimulatory domains include costimulatory domains of 41BB (SEQ ID NO: 69 and SEQ ID NO: 4068) and CD28 (SEQ ID NO:69 and SEQ ID NO; 4067). CD3z chains containing 41BB (BB) (see, schematic "C", above) and CD28 (see, schematic "D", above) costimulatory domains are presented in SEQ ID NO (DNA): 76-79 and SEQ ID NO: (PRT): 4075-4078. An exemplary zSIR with CD3z containing CD28 constimulatory domains is presented by CD8SP-BCMA-Am06-HL-vL-[CD3zECDTM-28z-opt]-F-P2A-SP-BCMA-Am06-HL-vH-[CD3zECDTM-28z-opt2] (SEQ ID NO (DNA): 3971 and (SEQ ID NO (PRT): 7971). An exemplary zSIR with CD3z containing 41BB constimulatory domains is presented by CD8SP-BCMA-Am06-HL-vH-[CD3zECDTM-BBz-opt]-F-P2A-SP-BCMA-Am06-HL-vH-[CD3zECDTM-BBz-opt2] (SEQ ID NO (DNA): 3972 and (SEQ ID NO (PRT): 7972). zSIRs 4-9 resemble zSIRs 1-3 except substitution of CD3zECDTMCP with CD3zECDTM-BBz or with CD3zECDTM-28z domains.

TABLE 1

Table 1 Exemplary CARs

| | | | | | | | |
|---|---|---|---|---|---|---|---|
| CAR 1 | CAR 1 or CAR I (including TFP) | ASD | HR | TMD | ISD | | |
| CAR 2 | CAR 2 (CAR II) | ASD | HR | TMD | CSD | ISD | |
| CAR 3 | CAR 3 (CAR III) | ASD | HR | TMD | CSD-I | CSD-II | ISD |
| CAR 4 | AbTCR | vL-cL | TCRD(1) | 2A | vH-CH1 | TCRD (II) | |
| CAR 5 | Double Chain cTCR/SIR | vL | TCR-C(1) | 2A | vH | TCR-C (II) | |
| CAR 6 | One & Half Chain cTCR/SIR | | TCR-C(1) | 2A | ASD | TCR-C (II) | |
| CAR 7 | zSIR1 | vL | CD3zECD TMCP | 2A | vH | CD3zECD TMCP | |
| CAR 8 | zSIR2 | ASD | CD3zECD TMCP | 2A | ASD | CD3zECD TMCP | |
| CAR 9 | zSIR3 | vL-cL | CD3zECD TMCP | 2A | vH-CH1 | CD3zECD TMCP | |
| CAR 10 | zSIR4 | vL | CD3zECD TM-BBz | 2A | vH | CD3zECD TM-BBz | |
| CAR 11 | zSIR5 | vL | CD3zECD TM-28z | 2A | vH | CD3zECD TM-28z | |
| CAR 12 | zSIR6 | ASD | CD3zECD TM-BBz | 2A | ASD | CD3zECD TM-BBz | |
| CAR 13 | zSIR7 | ASD | CD3zECD TM-28z | 2A | ASD | CD3zECD TM-28z | |
| CAR 14 | zSIR8 | vL-cL | CD3zECD TM-BBz | 2A | vH-CH1 | CD3zECD TM-BBz | |
| CAR 15 | zSIR9 | vL-cL | CD3zECD TM-28z | 2A | vH-CH1 | CD3zECD TM-28z | |

TABLE 2

Exemplary Backbones

| Backbone | CAR Component | Accessory Module NAME | SEQ ID (DNA) | SEQ ID (PRT) |
|---|---|---|---|---|
| Backbone 1 | CAR I | K13-vFLIP | 108 | 4107 |
| Backbone 2 | CAR I | FKBPX2-K13 | 113 | 4112 |
| Backbone 3 | CAR I | tBCMA | 97 | 4096 |
| Backbone 4 | CAR I | HIV-1 Vif | 118 | 4117 |
| Backbone 5 | CAR II | K13-vFLIP | 108 | 4107 |
| Backbone 6 | CAR II | FKBPX2-K13 | 113 | 4112 |
| Backbone 7 | CAR II | tBCMA | 97 | 4096 |
| Backbone 8 | CAR II | HIV-1 Vif | 118 | 4117 |
| Backbone 9 | CAR III | K13-vFLIP | 108 | 4107 |
| Backbone 10 | CAR III | FKBPX2-K13 | 113 | 4112 |
| Backbone 11 | CAR III | tBCMA | 97 | 4096 |
| Backbone 12 | CAR III | HIV-1 Vif | 118 | 4117 |
| Backbone 13 | AbTCR | K13-vFLIP | 108 | 4107 |
| Backbone 14 | AbTCR | FKBPX2-K13 | 113 | 4112 |
| Backbone 15 | AbTCR | tBCMA | 97 | 4096 |
| Backbone 16 | AbTCR | HIV-1 Vif | 118 | 4117 |
| Backbone 17 | DC-cTCR/SIR | K13-vFLIP | 108 | 4107 |
| Backbone 18 | DC-cTCR/SIR | FKBPX2-K13 | 113 | 4112 |
| Backbone 19 | DC-cTCR/SIR | tBCMA | 97 | 4096 |
| Backbone 20 | DC-cTCR/SIR | HIV-1 Vif | 118 | 4117 |
| Backbone 21 | OHC-cTCR/SIR | K13-vFLIP | 108 | 4107 |
| Backbone 22 | OHC-cTCR/SIR | FKBPX2-K13 | 113 | 4112 |
| Backbone 23 | OHC-cTCR/SIR | tBCMA | 97 | 4096 |
| Backbone 24 | OHC-cTCR/SIR | HIV-1 Vif | 118 | 4117 |
| Backbone 25 | zSIR1 | K13-vFLIP | 108 | 4107 |
| Backbone 26 | zSIR1 | FKBPX2-K13 | 113 | 4112 |
| Backbone 27 | zSIR1 | tBCMA | 97 | 4096 |
| Backbone 28 | zSIR1 | HIV-1 Vif | 118 | 4117 |
| Backbone 29 | zSIR2 | K13-vFLIP | 108 | 4107 |
| Backbone 30 | zSIR2 | FKBPX2-K13 | 113 | 4112 |
| Backbone 31 | zSIR2 | tBCMA | 97 | 4096 |
| Backbone 32 | zSIR2 | HIV-1 Vif | 118 | 4117 |
| Backbone 33 | zSIR3 | K13-vFLIP | 108 | 4107 |
| Backbone 34 | zSIR3 | FKBPX2-K13 | 113 | 4112 |
| Backbone 35 | zSIR3 | tBCMA | 97 | 4096 |
| Backbone 36 | zSIR3 | HIV-1 Vif | 118 | 4117 |
| Backbone 37 | zSIR4 | K13-vFLIP | 108 | 4107 |
| Backbone 38 | zSIR4 | FKBPX2-K13 | 113 | 4112 |
| Backbone 39 | zSIR4 | tBCMA | 97 | 4096 |
| Backbone 40 | zSIR4 | HIV-1 Vif | 118 | 4117 |
| Backbone 41 | zSIR5 | K13-vFLIP | 108 | 4107 |
| Backbone 42 | zSIR5 | FKBPX2-K13 | 113 | 4112 |
| Backbone 43 | zSIR5 | tBCMA | 97 | 4096 |
| Backbone 44 | zSIR5 | HIV-1 Vif | 118 | 4117 |
| Backbone 45 | zSIR6 | K13-vFLIP | 108 | 4107 |
| Backbone 46 | zSIR6 | FKBPX2-K13 | 113 | 4112 |
| Backbone 47 | zSIR6 | tBCMA | 97 | 4096 |
| Backbone 48 | zSIR6 | HIV-1 Vif | 118 | 4117 |
| Backbone 49 | zSIR7 | K13-vFLIP | 108 | 4107 |
| Backbone 50 | zSIR7 | FKBPX2-K13 | 113 | 4112 |
| Backbone 51 | zSIR7 | tBCMA | 97 | 4096 |
| Backbone 52 | zSIR7 | HIV-1 Vif | 118 | 4117 |
| Backbone 53 | zSIR8 | K13-vFLIP | 108 | 4107 |
| Backbone 54 | zSIR8 | FKBPX2-K13 | 113 | 4112 |
| Backbone 55 | zSIR8 | tBCMA | 97 | 4096 |
| Backbone 56 | zSIR8 | HIV-1 Vif | 118 | 4117 |
| Backbone 57 | zSIR9 | K13-vFLIP | 108 | 4107 |
| Backbone 58 | zSIR9 | FKBPX2-K13 | 113 | 4112 |
| Backbone 59 | zSIR9 | tBCMA | 97 | 4096 |
| Backbone 60 | zSIR9 | HIV-1 Vif | 118 | 4117 |

TABLE 3

Sequence listing of vL, vH and scFv Fragments targeting different antigens that are used in the construction of CARs

| | | vL | | vH | | scFv | |
|---|---|---|---|---|---|---|---|
| Antigen Target | Antigen binding domain | DNA SEQ ID | PRT SEQ ID | DNA SEQ ID | PRT SEQ ID | DNA SEQ ID | PRT SEQ ID |
| BCMA | BCMA-Am14-HL | 155 | 4118 | 229 | 4192 | 303 | 4266 |
| BCMA | BCMA-Am08-HL | 156 | 4119 | 230 | 4193 | 304 | 4267 |
| BCMA | BCMA-Am06-HL | 157 | 4120 | 231 | 4194 | 305 | 4268 |
| CD19 | hu-CAT18-1-HL | 158 | 4121 | 232 | 4195 | 306 | 4269 |
| CD19 | CAT17-HL | 159 | 4122 | 233 | 4196 | 307 | 4270 |
| CD22 | hu-HA22-1 | 160 | 4123 | 234 | 4197 | 308 | 4271 |

TABLE 3-continued

Sequence listing of vL, vH and scFv Fragments targeting different antigens that are used in the construction of CARs

| | | vL | | vH | | scFv | |
|---|---|---|---|---|---|---|---|
| Antigen Target | Antigen binding domain | DNA SEQ ID | PRT SEQ ID | DNA SEQ ID | PRT SEQ ID | DNA SEQ ID | PRT SEQ ID |
| CD19 | CD19-DART1 | 161 | 4124 | 235 | 4198 | 309 | 4272 |
| CD20 | hu-Ubli-1-v4 | 162 | 4125 | 236 | 4199 | 310 | 4273 |
| Integrin B7 | Hu-IntB7-MMG49 | 163 | 4126 | 237 | 4200 | 311 | 4274 |
| BCMA | BCMA-BB-CAR02 | 164 | 4127 | 238 | 4201 | 312 | 4275 |
| Her2 | Her2-169 | 165 | 4128 | 239 | 4202 | 313 | 4276 |
| Her2 | Her2-XMT-1520 | 166 | 4129 | 240 | 4203 | 314 | 4277 |
| Her2 | Her2-XMT-1518 | 167 | 4130 | 241 | 4204 | 315 | 4278 |
| Her2 | Her2-huMab4D5-D98W | 168 | 4131 | 242 | 4205 | 316 | 4279 |
| TSHR | TSHR-hu-3BD10 | 169 | 4132 | 243 | 4206 | 317 | 4280 |
| PSMA | PSMA-83A12-HL-AM | 170 | 4133 | 244 | 4207 | 318 | 4281 |
| PSMA | PSMA-76-HL-AM | 171 | 4134 | 245 | 4208 | 319 | 4282 |
| PSMA | hu106mPSMA-4-HL | 172 | 4135 | 246 | 4209 | 320 | 4283 |
| MSLN | MSLN-3-HL-AM | 173 | 4136 | 247 | 4210 | 321 | 4284 |
| MSLN | MSLN-5-HL | 174 | 4137 | 248 | 4211 | 322 | 4285 |
| EGFRviii | EGFRviii-2-AM-HL | 175 | 4138 | 249 | 4212 | 323 | 4286 |
| EGFRviii | EGFRviii-H2M1863N2-HL | 176 | 4139 | 250 | 4213 | 324 | 4287 |
| EGFRviii | EGFRviii-H2M1915N-HL | 177 | 4140 | 251 | 4214 | 325 | 4288 |
| EGFRviii | EGFRviii-131-2 | 178 | 4141 | 252 | 4215 | 326 | 4289 |
| DLL3 | DLL3-AM6-HL | 179 | 4142 | 253 | 4216 | 327 | 4290 |
| DLL3 | DLL3-AM14-HL | 180 | 4143 | 254 | 4217 | 328 | 4291 |
| Nectin4 | Nectin4-66-HL | 181 | 4144 | 255 | 4218 | 329 | 4292 |
| MSLN | MSLN-237-HL | 182 | 4145 | 256 | 4219 | 330 | 4293 |
| MSLN | MSLN-HuAM15 | 183 | 4146 | 257 | 4220 | 331 | 4294 |
| MSLN | MSLN76923-HL | 184 | 4147 | 258 | 4221 | 332 | 4295 |
| Prolactin Receptor | PRLR-CN | 185 | 4148 | 259 | 4222 | 333 | 4296 |
| Muc17 | Muc17-11-CN | 186 | 4149 | 260 | 4223 | 334 | 4297 |
| CD19 | CD19-AM1 | 187 | 4150 | 261 | 4224 | 335 | 4298 |
| CD19 | CD19-9B7 | 188 | 4151 | 262 | 4225 | 336 | 4299 |
| CD20 | CD20-HL | 189 | 4152 | 263 | 4226 | 337 | 4300 |
| CD70 | CD70-HL-AM13 | 190 | 4153 | 264 | 4227 | 338 | 4301 |
| CDH19 | CDH19-USC1-HLv4 | 191 | 4154 | 265 | 4228 | 339 | 4302 |
| CDH19 | CDH19-USC2-HL | 192 | 4155 | 266 | 4229 | 340 | 4303 |
| CD16ORF54 | C16ORF54-USC1-v4 | 193 | 4156 | 267 | 4230 | 341 | 4304 |
| VISTA | huVISTA-USC1-v4 | 194 | 4157 | 268 | 4231 | 342 | 4305 |
| VISTA | huVISTA-JJ-USC2-v4 | 195 | 4158 | 269 | 4232 | 343 | 4306 |
| GPC3 | GPC3-USC1-HL-V4 | 196 | 4159 | 270 | 4233 | 344 | 4307 |
| GPC3 | GPC3-USC2-HL-V4 | 197 | 4160 | 271 | 4234 | 345 | 4308 |
| PRLR | PRLR-USC2-HL-V4 | 198 | 4161 | 272 | 4235 | 346 | 4309 |
| Muc5Ac | Muc5Ac-USC1-HL-V4 | 199 | 4162 | 273 | 4236 | 347 | 4310 |
| FCRH5 | FCRH5-USC1-HL-V4 | 200 | 4163 | 274 | 4237 | 348 | 4311 |
| LYPD1 | LYPD1-HL-V4 | 201 | 4164 | 275 | 4238 | 349 | 4312 |
| EMR2 | EMR2-USC1-V4 | 202 | 4165 | 276 | 4239 | 350 | 4313 |
| EMR2 | EMR2-USC2-V4 | 203 | 4166 | 277 | 4240 | 351 | 4314 |
| EMR2 | mEMR2-USC3-V4 | 204 | 4167 | 278 | 4241 | 352 | 4315 |
| gpNMB | m-gPNMB-USC1-HL-v4 | 205 | 4168 | 279 | 4242 | 353 | 4316 |
| RNF43 | RNF43-USC1-HL4 | 206 | 4169 | 280 | 4243 | 354 | 4317 |
| RNF43 | RNF43-USC2-HL4 | 207 | 4170 | 281 | 4244 | 355 | 4318 |
| CD44v6 | CD44v6-USC1-HL4 | 208 | 4171 | 282 | 4245 | 356 | 4319 |
| Robo4 | Robo4-USC1 | 209 | 4172 | 283 | 4246 | 357 | 4320 |
| CEA | CEA-USC1-HL4 | 210 | 4173 | 284 | 4247 | 358 | 4321 |
| Her3 | Her3-USC1-HL4 | 211 | 4174 | 285 | 4248 | 359 | 4322 |
| FOLR1 | FOLR1-USC1-HL4 | 212 | 4175 | 286 | 4249 | 360 | 4323 |
| FOLR1 | FOLR1-USC2-HL4 | 213 | 4176 | 287 | 4250 | 361 | 4324 |
| CLDN6 | CLDN6-USC1-LH4 | 214 | 4177 | 288 | 4251 | 362 | 4325 |
| CLDN6 | CLDN6-USC2-LH4 | 215 | 4178 | 289 | 4252 | 363 | 4326 |
| MMP16 | hMMP16-USC-1-LH4 | 216 | 4179 | 290 | 4253 | 364 | 4327 |
| UPK1B | hUPK1B-USC1-LH4 | 217 | 4180 | 291 | 4254 | 365 | 4328 |
| UPK1B | hUPK1B-USC2-LH4 | 218 | 4181 | 292 | 4255 | 366 | 4329 |
| BMPR1B | hBMPR1B-USC1-LH4 | 219 | 4182 | 293 | 4256 | 367 | 4330 |
| BMPR1B | hBMPR1B-USC2-LH4 | 220 | 4183 | 294 | 4257 | 368 | 4331 |
| Ly6E | Ly6E-USC1-HL4 | 221 | 4184 | 295 | 4258 | 369 | 4332 |
| STEAP1 | STEAP1-USC1-HL4 | 222 | 4185 | 296 | 4259 | 370 | 4333 |
| CD79b | CD79b-USC1-LH4 | 223 | 4186 | 297 | 4260 | 371 | 4334 |
| WISP1 | hu-UISP1-USC1-LH4 | 224 | 4187 | 298 | 4261 | 372 | 4335 |
| WISP1 | hu-UISP1-USC2-LH4 | 225 | 4188 | 299 | 4262 | 373 | 4336 |
| SLC34A2 | huMX35-LH4 | 226 | 4189 | 300 | 4263 | 374 | 4337 |
| CD19 | hu-CD19-USC1-LH4 | 227 | 4190 | 301 | 4264 | 375 | 4338 |
| CD22 | CD22-HA22 | 8000 | 9631 | 8031 | 9662 | 8062 | 9693 |
| STEAP1 | STEAP1-hu120 | 8001 | 9632 | 8032 | 9663 | 8063 | 9694 |
| Liv1 | hLiv1-mAb2 | 8002 | 9633 | 8033 | 9664 | 8064 | 9695 |
| Nectin4 | hu-Nectin4-mAb1 | 8003 | 9634 | 8034 | 9665 | 8065 | 9696 |
| Cripto | hu-Cripto-L1H2 | 8004 | 9635 | 8035 | 9666 | 8066 | 9697 |

TABLE 3-continued

Sequence listing of vL, vH and scFv Fragments targeting different antigens that are used in the construction of CARs

| | | vL | | vH | | scFv | |
|---|---|---|---|---|---|---|---|
| Antigen Target | Antigen binding domain | DNA SEQ ID | PRT SEQ ID | DNA SEQ ID | PRT SEQ ID | DNA SEQ ID | PRT SEQ ID |
| gpA33 | hu-gpA33 | 8005 | 9636 | 8036 | 9667 | 8067 | 9698 |
| ROR1 | ROR1-DART4 | 8006 | 9637 | 8037 | 9668 | 8068 | 9699 |
| BCMA | BCMA-FS | 8007 | 9638 | 8038 | 9669 | 8069 | 9700 |
| BCMA | BCMA-PC | 8008 | 9639 | 8039 | 9670 | 8070 | 9701 |
| BCMA | BCMA-AJ | 8009 | 9640 | 8040 | 9671 | 8071 | 9702 |
| BCMA | BCMA-NM | 8010 | 9641 | 8041 | 9672 | 8072 | 9703 |
| BCMA | BCMA-TS | 8011 | 9642 | 8042 | 9673 | 8073 | 9704 |
| BCMA | BCMA-PP | 8012 | 9643 | 8043 | 9674 | 8074 | 9705 |
| BCMA | BCMA-RD | 8013 | 9644 | 8044 | 9675 | 8075 | 9706 |
| BCMA | BCMA-BB-CAR02 | 8014 | 9645 | 8045 | 9676 | 8076 | 9707 |
| CLL1 | CLL1-24C8 | 8015 | 9646 | 8046 | 9677 | 8077 | 9708 |
| CLL1 | CLL1-24C1 | 8016 | 9647 | 8047 | 9678 | 8078 | 9709 |
| FLT3 | FLT3-10E3 | 8017 | 9648 | 8048 | 9679 | 8079 | 9710 |
| FLT3 | FLT3-8B5 | 8018 | 9649 | 8049 | 9680 | 8080 | 9711 |
| IL1RAP | IL1RAP-IAPB57 | 8019 | 9650 | 8050 | 9681 | 8081 | 9712 |
| IL1RAP | IL1RAP-IAPB63 | 8020 | 9651 | 8051 | 9682 | 8082 | 9713 |
| IL1RAP | hu-IL1RAP-CANO4 | 8021 | 9652 | 8052 | 9683 | 8083 | 9714 |
| MSLN | MSLN-7D9-v3 | 8022 | 9653 | 8053 | 9684 | 8084 | 9715 |
| MSLN | MSLN-hu22A10 | 8023 | 9654 | 8054 | 9685 | 8085 | 9716 |
| CD19 | hu-Bu13 | 8024 | 9655 | 8055 | 9686 | 8086 | 9717 |
| BST1 | hu-BST1-A1 | 8025 | 9656 | 8056 | 9687 | 8087 | 9718 |
| BST1 | hu-BST1-A2 | 8026 | 9657 | 8057 | 9688 | 8088 | 9719 |
| BST1 | hu-BST1-A3 | 8027 | 9658 | 8058 | 9689 | 8089 | 9720 |
| Her2 | Her2-XMT-1519 | 8028 | 9659 | 8059 | 9690 | 8090 | 9721 |
| Her2 | Her2-XMT-1517 | 8029 | 9660 | 8060 | 9691 | 8091 | 9722 |
| CD133 | CD133-RW03 | 11300 | 11460 | 11304 | 11464 | 11308 | 11468 |
| CD133 | CD133-W6B3H10 | 11301 | 11461 | 11305 | 11465 | 11309 | 11469 |
| CD133 | CD133-293AC1C3B9 | 11302 | 11462 | 11306 | 11466 | 11310 | 11470 |
| IL113Ra2 | hu-IL13Ra2-mAb47 | 12642 | 14386 | 12673 | 14417 | 12704 | 14448 |
| CD22 | CD22-INO | 12643 | 14387 | 12674 | 14418 | 12705 | 14449 |
| CD22 | CD22-CELL4 | 12644 | 14388 | 12675 | 14419 | 12706 | 14450 |
| CD22 | CD22-CELL13 | 12645 | 14389 | 12676 | 14420 | 12707 | 14451 |
| CD22 | CD22-CELL7 | 12646 | 14390 | 12677 | 14421 | 12708 | 14452 |
| CD22 | CD22-VM1011 | 12647 | 14391 | 12678 | 14422 | 12709 | 14453 |
| CD22 | CD22-RAB-4120 | 12648 | 14392 | 12679 | 14423 | 12710 | 14454 |
| CD22 | CD22-Med-12C5-HL | 12649 | 14393 | 12680 | 14424 | 12711 | 14455 |
| CD22 | CD22-Med-19A3 | 12650 | 14394 | 12681 | 14425 | 12712 | 14456 |
| CD22 | CD22-Med-16F7 | 12651 | 14395 | 12682 | 14426 | 12713 | 14457 |
| CD22 | hu-RFB4 | 12652 | 14396 | 12683 | 14427 | 12714 | 14458 |
| BCMA | BCMA-mJ22-9 | 12653 | 14397 | 12684 | 14428 | 12715 | 14459 |
| BCMA | BCMA-huJ22-10 | 12654 | 14398 | 12685 | 14429 | 12716 | 14460 |
| CD22 | CD22-hu-HA22-2 | 12655 | 14399 | 12686 | 14430 | 12717 | 14461 |
| CD19 | huCD19-USC3 | 12656 | 14400 | 12687 | 14431 | 12718 | 14462 |
| CD22 | BCMA-hu72 | 12657 | 14401 | 12688 | 14432 | 12719 | 14463 |
| MPL | hu-161-3 | 12658 | 14402 | 12689 | 14433 | 12720 | 14464 |
| BAFF-R | hu-BAFFR-USC90 | 12659 | 14403 | 12690 | 14434 | 12721 | 14465 |
| BAFF-R | hu-BAFFR-USC55 | 12660 | 14404 | 12691 | 14435 | 12722 | 14466 |
| BAFF-R | hu-BAFFR-MOR6654 | 12661 | 14405 | 12692 | 14436 | 12723 | 14467 |
| CD19 | CD19-hu-mROO5-1 | 12662 | 14406 | 12693 | 14437 | 12724 | 14468 |
| CD22 | CD22-h10F4v2 | 12663 | 14407 | 12694 | 14438 | 12725 | 14469 |
| CD22 | CD22-HA22 | 12664 | 14408 | 12695 | 14439 | 12726 | 14470 |
| MPL | hu-161-2 | 12665 | 14409 | 12696 | 14440 | 12727 | 14471 |
| MSLN | MSLN-hu22A10 | 12666 | 14410 | 12697 | 14441 | 12728 | 14472 |
| MSLN | MSLN-7D9-HL | 12667 | 14411 | 12698 | 14442 | 12729 | 14473 |
| MSLN | MSLN-5 | 12668 | 14412 | 12699 | 14443 | 12730 | 14474 |
| BCMA | BCMA-huC13-F12 | 12669 | 14413 | 12700 | 14444 | 12731 | 14475 |
| BCMA | BCMA-huC12A3-L3H3 | 12670 | 14414 | 12701 | 14445 | 12732 | 14476 |
| BCMA | BCMA-J6M0 | 12671 | 14415 | 12702 | 14446 | 12733 | 14477 |

TABLE 4

SEQUENCE LISTING OF VARIOUS CDRs of vL and vH REGIONS BELONGING TO DIFFERENT ANTIGEN BINDING DOMAINS TARGETING DIFFERENT ANTIGENS

| Antigen Target | Antigen binding domain | vL-CDR1 | vL-CDR2 | vL-CDR3 | vH-CDR1 | vH-CDR2 | vH-CDR3 |
|---|---|---|---|---|---|---|---|
| BCMA | BCMA-Am14-HL | 11961 | 12068 | 12175 | 12282 | 12389 | 12497 |
| BCMA | BCMA-Am08-HL | 11962 | 12069 | 12176 | 12283 | 12390 | 12498 |

TABLE 4-continued

SEQUENCE LISTING OF VARIOUS CDRs of vL and vH REGIONS BELONGING TO DIFFERENT ANTIGEN BINDING DOMAINS TARGETING DIFFERENT ANTIGENS

| Antigen Target | Antigen binding domain | vL-CDR1 | vL-CDR2 | vL-CDR3 | vH-CDR1 | vH-CDR2 | vH-CDR3 |
|---|---|---|---|---|---|---|---|
| BCMA | BCMA-Am06-HL | 11963 | 12070 | 12177 | 12284 | 12391 | 12499 |
| CD19 | hu-CAT18-1-HL | 11964 | 12071 | 12178 | 12285 | 12392 | 12500 |
| CD19 | CAT17-HL | 11965 | 12072 | 12179 | 12286 | 12393 | 12501 |
| CD22 | hu-HA22-1 | 11966 | 12073 | 12180 | 12287 | 12394 | 12502 |
| CD19 | CD19-DART1 | 11967 | 12074 | 12181 | 12288 | 12395 | 12503 |
| CD20 | hu-Ubli-1-v4 | 11968 | 12075 | 12182 | 12289 | 12396 | 12504 |
| Integrin B7 | Hu-IntB7-MMG49 | 11969 | 12076 | 12183 | 12290 | 12397 | 12505 |
| BCMA | BCMA-BB-CAR02 | 11970 | 12077 | 12184 | 12291 | 12398 | 12506 |
| Her2 | Her2-169 | 11971 | 12078 | 12185 | 12292 | 12399 | 12507 |
| Her2 | Her2-XMT-1520 | 11972 | 12079 | 12186 | 12293 | 12400 | 12508 |
| Her2 | Her2-XMT-1518 | 11973 | 12080 | 12187 | 12294 | 12401 | 12509 |
| Her2 | Her2-huMab4D5-D98W | 11974 | 12081 | 12188 | 12295 | 12402 | 12510 |
| TSHR | TSHR-hu-3BD10 | 11975 | 12082 | 12189 | 12296 | 12403 | 12511 |
| PSMA | PSMA-83A12-HL-AM | 11976 | 12083 | 12190 | 12297 | 12404 | 12512 |
| PSMA | PSMA-76-HL-AM | 11977 | 12084 | 12191 | 12298 | 12405 | 12513 |
| PSMA | hu106mPSMA-4-HL | 11978 | 12085 | 12192 | 12299 | 12406 | 12514 |
| MSLN | MSLN-3-HL-AM | 11979 | 12086 | 12193 | 12300 | 12407 | 12515 |
| MSLN | MSLN-5-HL | 11980 | 12087 | 12194 | 12301 | 12408 | 12516 |
| EGFRviii | EGFRviii-2-AM-HL | 11981 | 12088 | 12195 | 12302 | 12409 | 12517 |
| EGFRviii | EGFRviii-H2M1863N2-HL | 11982 | 12089 | 12196 | 12303 | 12410 | 12518 |
| EGFRviii | EGFRviii-H2M1915N-HL | 11983 | 12090 | 12197 | 12304 | 12411 | 12519 |
| EGFRviii | EGFRviii-131-2 | 11984 | 12091 | 12198 | 12305 | 12412 | 12520 |
| DLL3 | DLL3-AM6-HL | 11985 | 12092 | 12199 | 12306 | 12413 | 12521 |
| DLL3 | DLL3-AM14-HL | 11986 | 12093 | 12200 | 12307 | 12414 | 12522 |
| Nectin4 | Nectin4-66-HL | 11987 | 12094 | 12201 | 12308 | 12415 | 12523 |
| MSLN | MSLN-237-HL | 11988 | 12095 | 12202 | 12309 | 12416 | 12524 |
| MSLN | MSLN-HuAM15 | 11989 | 12096 | 12203 | 12310 | 12417 | 12525 |
| MSLN | MSLN76923-HL | 11990 | 12097 | 12204 | 12311 | 12418 | 12526 |
| Prolactin Receptor | PRLR-CN | 11991 | 12098 | 12205 | 12312 | 12419 | 12527 |
| Muc17 | Muc17-11-CN | 11992 | 12099 | 12206 | 12313 | 12420 | 12528 |
| CD19 | CD19-AM1 | 11993 | 12100 | 12207 | 12314 | 12421 | 12529 |
| CD19 | CD19-9B7 | 11994 | 12101 | 12208 | 12315 | 12422 | 12530 |
| CD20 | CD20-HL | 11995 | 12102 | 12209 | 12316 | 12423 | 12531 |
| CD70 | CD70-HL-AM13 | 11996 | 12103 | 12210 | 12317 | 12424 | 12532 |
| CDH19 | CDH19-USC1-HLv4 | 11997 | 12104 | 12211 | 12318 | 12425 | 12533 |
| CDH19 | CDH19-USC2-HL | 11998 | 12105 | 12212 | 12319 | 12426 | 12534 |
| CD16ORF54 | C16ORF54-USC1-v4 | 11999 | 12106 | 12213 | 12320 | 12427 | 12535 |
| VISTA | huVISTA-USC1-v4 | 12000 | 12107 | 12214 | 12321 | 12428 | 12536 |
| VISTA | huVISTA-JJ-USC2-v4 | 12001 | 12108 | 12215 | 12322 | 12429 | 12537 |
| GPC3 | GPC3-USC1-HL-V4 | 12002 | 12109 | 12216 | 12323 | 12430 | 12538 |
| GPC3 | GPC3-USC2-HL-V4 | 12003 | 12110 | 12217 | 12324 | 12431 | 12539 |
| PRLR | PRLR-USC2-HL-V4 | 12004 | 12111 | 12218 | 12325 | 12432 | 12540 |
| Muc5Ac | Muc5Ac-USC1-HL-V4 | 12005 | 12112 | 12219 | 12326 | 12433 | 12541 |
| FCRH5 | FCRH5-USC1-HL-V4 | 12006 | 12113 | 12220 | 12327 | 12434 | 12542 |
| LYPD1 | LYPD1-HL-V4 | 12007 | 12114 | 12221 | 12328 | 12435 | 12543 |
| EMR2 | EMR2-USC1-V4 | 12008 | 12115 | 12222 | 12329 | 12436 | 12544 |
| EMR2 | EMR2-USC2-V4 | 12009 | 12116 | 12223 | 12330 | 12437 | 12545 |
| EMR2 | mEMR2-USC3-V4 | 12010 | 12117 | 12224 | 12331 | 12438 | 12546 |
| gpNMB | m-gPNMB-USC1-HL-v4 | 12011 | 12118 | 12225 | 12332 | 12439 | 12547 |
| RNF43 | RNF43-USC1-HL4 | 12012 | 12119 | 12226 | 12333 | 12440 | 12548 |
| RNF43 | RNF43-USC2-HL4 | 12013 | 12120 | 12227 | 12334 | 12441 | 12549 |
| CD44v6 | CD44v6-USC1-HL4 | 12014 | 12121 | 12228 | 12335 | 12442 | 12550 |
| Robo4 | Robo4-USC1 | 12015 | 12122 | 12229 | 12336 | 12443 | 12551 |
| CEA | CEA-USC1-HL4 | 12016 | 12123 | 12230 | 12337 | 12444 | 12552 |
| Her3 | Her3-USC1-HL4 | 12017 | 12124 | 12231 | 12338 | 12445 | 12553 |
| FOLR1 | FOLR1-USC1-HL4 | 12018 | 12125 | 12232 | 12339 | 12446 | 12554 |
| FOLR1 | FOLR1-USC2-HL4 | 12019 | 12126 | 12233 | 12340 | 12447 | 12555 |
| CLDN6 | CLDN6-USC1-LH4 | 12020 | 12127 | 12234 | 12341 | 12448 | 12556 |
| CLDN6 | CLDN6-USC2-LH4 | 12021 | 12128 | 12235 | 12342 | 12449 | 12557 |
| MMP16 | hMMP16-USC-1-LH4 | 12022 | 12129 | 12236 | 12343 | 12450 | 12558 |
| UPK1B | hUPK1B-USC1-LH4 | 12023 | 12130 | 12237 | 12344 | 12451 | 12559 |
| UPK1B | hUPK1B-USC2-LH4 | 12024 | 12131 | 12238 | 12345 | 12452 | 12560 |
| BMPR1B | hBMPR1B-USC1-LH4 | 12025 | 12132 | 12239 | 12346 | 12453 | 12561 |
| BMPR1B | hBMPR1B-USC2-LH4 | 12026 | 12133 | 12240 | 12347 | 12454 | 12562 |
| Ly6E | Ly6E-USC1-HL4 | 12027 | 12134 | 12241 | 12348 | 12455 | 12563 |
| STEAP1 | STEAP1-USC1-HL4 | 12028 | 12135 | 12242 | 12349 | 12456 | 12564 |
| CD79b | CD79b-USC1-LH4 | 12029 | 12136 | 12243 | 12350 | 12457 | 12565 |
| WISP1 | hu-UISP1-USC1-LH4 | 12030 | 12137 | 12244 | 12351 | 12458 | 12566 |
| WISP1 | hu-UISP1-USC2-LH4 | 12031 | 12138 | 12245 | 12352 | 12459 | 12567 |
| SLC34A2 | huMX35-LH4 | 12032 | 12139 | 12246 | 12353 | 12460 | 12568 |
| CD 19 | hu-CD19-USC1-LH4 | 12033 | 12140 | 12247 | 12354 | 12461 | 12569 |
| CD22 | CD22-HA22 | 12034 | 12141 | 12248 | 12355 | 12462 | 12570 |
| STEAP1 | STEAP1-hu120 | 12035 | 12142 | 12249 | 12356 | 12463 | 12571 |
| Liv1 | hLiv1-mAb2 | 12036 | 12143 | 12250 | 12357 | 12464 | 12572 |

TABLE 4-continued

| SEQUENCE LISTING OF VARIOUS CDRs of vL and vH REGIONS BELONGING TO DIFFERENT ANTIGEN BINDING DOMAINS TARGETING DIFFERENT ANTIGENS | | | | | | | |
|---|---|---|---|---|---|---|---|
| Antigen Target | Antigen binding domain | vL-CDR1 | vL-CDR2 | vL-CDR3 | vH-CDR1 | vH-CDR2 | vH-CDR3 |
| Nectin4 | hu-Nectin4-mAb1 | 12037 | 12144 | 12251 | 12358 | 12465 | 12573 |
| Cripto | hu-Cripto-L1H2 | 12038 | 12145 | 12252 | 12359 | 12466 | 12574 |
| gpA33 | hu-gpA33 | 12039 | 12146 | 12253 | 12360 | 12467 | 12575 |
| R0R1 | ROR1-DART4 | 12040 | 12147 | 12254 | 12361 | 12468 | 12576 |
| BCMA | BCMA-FS | 12041 | 12148 | 12255 | 12362 | 12469 | 12577 |
| BCMA | BCMA-PC | 12042 | 12149 | 12256 | 12363 | 12470 | 12578 |
| BCMA | BCMA-AJ | 12043 | 12150 | 12257 | 12364 | 12471 | 12579 |
| BCMA | BCMA-NM | 12044 | 12151 | 12258 | 12365 | 12472 | 12580 |
| BCMA | BCMA-TS | 12045 | 12152 | 12259 | 12366 | 12473 | 12581 |
| BCMA | BCMA-PP | 12046 | 12153 | 12260 | 12367 | 12474 | 12582 |
| BCMA | BCMA-RD | 12047 | 12154 | 12261 | 12368 | 12475 | 12583 |
| BCMA | BCMA-BB-CAR02 | 12048 | 12155 | 12262 | 12369 | 12476 | 12584 |
| CLL1 | CLL1-24C8 | 12049 | 12156 | 12263 | 12370 | 12477 | 12585 |
| CLL1 | CLL1-24C1 | 12050 | 12157 | 12264 | 12371 | 12478 | 12586 |
| FLT3 | FLT3-10E3 | 12051 | 12158 | 12265 | 12372 | 12479 | 12587 |
| FLT3 | FLT3-8B5 | 12052 | 12159 | 12266 | 12373 | 12480 | 12588 |
| IL1RAP | IL1RAP-IAPB57 | 12053 | 12160 | 12267 | 12374 | 12481 | 12589 |
| IL1RAP | IL1RAP-IAPB63 | 12054 | 12161 | 12268 | 12375 | 12482 | 12590 |
| IL1RAP | hu-IL1RAP-CAN04 | 12055 | 12162 | 12269 | 12376 | 12483 | 12591 |
| MSLN | MSLN-7D9-v3 | 12056 | 12163 | 12270 | 12377 | 12484 | 12592 |
| MSLN | MSLN-hu22A10 | 12057 | 12164 | 12271 | 12378 | 12485 | 12593 |
| CD19 | hu-Bu13 | 12058 | 12165 | 12272 | 12379 | 12486 | 12594 |
| BST1 | hu-BST1-A1 | 12059 | 12166 | 12273 | 12380 | 12487 | 12595 |
| BST1 | hu-BST1-A2 | 12060 | 12167 | 12274 | 12381 | 12488 | 12596 |
| BST1 | hu-BST1-A3 | 12061 | 12168 | 12275 | 12382 | 12489 | 12597 |
| Her2 | Her2-XMT-1519 | 12062 | 12169 | 12276 | 12383 | 12490 | 12598 |
| Her2 | Her2-XMT-1517 | 12063 | 12170 | 12277 | 12384 | 12491 | 12599 |
| CD133 | CD133-RW03 | 12064 | 12171 | 12278 | 12385 | 12492 | 12600 |
| CD133 | CD133-W6B3H10 | 12065 | 12172 | 12279 | 12386 | 12493 | 12601 |
| CD133 | CD133-293AC1C3B9 | 12066 | 12173 | 12280 | 12387 | 12494 | 12602 |
| IL113Ra2 | hu-IL13Ra2-mAb47 | 16126 | 16157 | 16188 | 16219 | 16250 | 16281 |
| CD22 | CD22-INO | 16127 | 16158 | 16189 | 16220 | 16251 | 16282 |
| CD22 | CD22-CELL4 | 16128 | 16159 | 16190 | 16221 | 16252 | 16283 |
| CD22 | CD22-CELL13 | 16129 | 16160 | 16191 | 16222 | 16253 | 16284 |
| CD22 | CD22-CELL7 | 16130 | 16161 | 16192 | 16223 | 16254 | 16285 |
| CD22 | CD22-VM1011 | 16131 | 16162 | 16193 | 16224 | 16255 | 16286 |
| CD22 | CD22-RAB-4120 | 16132 | 16163 | 16194 | 16225 | 16256 | 16287 |
| CD22 | CD22-Med-12C5-HL | 16133 | 16164 | 16195 | 16226 | 16257 | 16288 |
| CD22 | CD22-Med-19A3 | 16134 | 16165 | 16196 | 16227 | 16258 | 16289 |
| CD22 | CD22-Med-16F7 | 16135 | 16166 | 16197 | 16228 | 16259 | 16290 |
| CD22 | hu-RFB4 | 16136 | 16167 | 16198 | 16229 | 16260 | 16291 |
| BCMA | BCMA-mJ22-9 | 16137 | 16168 | 16199 | 16230 | 16261 | 16292 |
| BCMA | BCMA-huJ22-10 | 16138 | 16169 | 16200 | 16231 | 16262 | 16293 |
| CD22 | CD22-hu-HA22-2 | 16139 | 16170 | 16201 | 16232 | 16263 | 16294 |
| CD19 | huCD19-USC3 | 16140 | 16171 | 16202 | 16233 | 16264 | 16295 |
| CD22 | BCMA-hu72 | 16141 | 16172 | 16203 | 16234 | 16265 | 16296 |
| MPL | hu-161-3 | 16142 | 16173 | 16204 | 16235 | 16266 | 16297 |
| BAFF-R | hu-BAFFR-USC90 | 16143 | 16174 | 16205 | 16236 | 16267 | 16298 |
| BAFF-R | hu-BAFFR-USC55 | 16144 | 16175 | 16206 | 16237 | 16268 | 16299 |
| BAFF-R | hu-BAFFR-MOR6654 | 16145 | 16176 | 16207 | 16238 | 16269 | 16300 |
| CD19 | CD19-hu-mROO5-1 | 16146 | 16177 | 16208 | 16239 | 16270 | 16301 |
| CD22 | CD22-h10F4v2 | 16147 | 16178 | 16209 | 16240 | 16271 | 16302 |
| CD22 | CD22-HA22 | 16148 | 16179 | 16210 | 16241 | 16272 | 16303 |
| MPL | hu-161-2 | 16149 | 16180 | 16211 | 16242 | 16273 | 16304 |
| MSLN | MSLN-hu22A10 | 16150 | 16181 | 16212 | 16243 | 16274 | 16305 |
| MSLN | MSLN-7D9-HL | 16151 | 16182 | 16213 | 16244 | 16275 | 16306 |
| MSLN | MSLN-5 | 16152 | 16183 | 16214 | 16245 | 16276 | 16307 |
| BCMA | BCMA-huC13-F12 | 16153 | 16184 | 16215 | 16246 | 16277 | 16308 |
| BCMA | BCMA-huC12A3-L3H3 | 16154 | 16185 | 16216 | 16247 | 16278 | 16309 |
| BCMA | BCMA-J6M0 | 16155 | 16186 | 16217 | 16248 | 16279 | 16310 |

TABLE 5

| CAR COMPONENT | DNA SEQ ID | PRT SEQ ID |
|---|---|---|
| CD8_Signal_Peptide | 1 | 4000 |
| CD8_Signal_Peptide | 2 | 4001 |
| IgH_Signal_Peptide | 3 | 4002 |
| IgH_Signal_Peptide | 4 | 4003 |
| (GGGGS)x3_LINKER | 5 | 4004 |
| DDAKK_linker | 6 | 4005 |

TABLE 5-continued

| CAR COMPONENT | DNA SEQ ID | PRT SEQ ID |
|---|---|---|
| GGGSG-Streptagx2-Tag | 7 | 4006 |
| PG4SP-linker | 8 | 4007 |
| PG4SP-v2-linker | 9 | 4008 |
| E-coil-linker | 10 | 4009 |
| K-coil-linker | 11 | 4010 |
| EAAAK-linker | 12 | 4011 |

TABLE 5-continued

| CAR COMPONENT | DNA SEQ ID | PRT SEQ ID |
|---|---|---|
| EAAAK-v2-linker | 13 | 4012 |
| Myc-(P)-TAG | 14 | 4013 |
| Myc-TAG | 15 | 4014 |
| MYC-TAG | 16 | 4015 |
| MYC2-TAG | 17 | 4016 |
| MYC4-TAG | 18 | 4017 |
| V5-TAG | 19 | 4018 |
| HA-TAG | 20 | 4019 |
| HIS-TAG | 21 | 4020 |
| AVI-TAG-delta-GSG | 22 | 4021 |
| G4Sx2-TAG | 23 | 4022 |
| G4Sx2-TAG | 24 | 4023 |
| StrepTagII | 25 | 4024 |
| StrepTagII | 26 | 4025 |
| FLAG-TAG | 27 | 4026 |
| IgCL | 28 | 4027 |
| IgG1-CH1 | 29 | 4028 |
| IgG2-0C-CHI | 30 | 4029 |
| IgG2-IC-CHI | 31 | 4030 |
| IgG3-CHI | 32 | 4031 |
| IgG4-CHI | 33 | 4032 |
| IgAI-CHI | 34 | 4033 |
| IgA2-CHI | 35 | 4034 |
| IgD-CHI | 36 | 4035 |
| IgE-CHI | 37 | 4036 |
| IgM-CHI | 38 | 4037 |
| hTCR-alpha-constant__X02883.1 | 39 | 4038 |
| hTCRa-WT | 40 | 4039 |
| hTCRa-CSDVP | 41 | 4040 |
| hTCRa-opt2 | 42 | 4041 |
| hTCRa-T48C-opt | 43 | 4042 |
| hTCRa-T48C-opt1 | 44 | 4043 |
| hTCRa-SDVP | 45 | 4044 |
| hTCRa-S61R | 46 | 4045 |
| hTCRa-SDVPR | 47 | 4046 |
| hTCRaECD-CD3zECDTMCP-opt2 | 48 | 4047 |
| hTCR-b1-constant-region__X00437.1 | 49 | 4048 |
| hTCR-b2-constant region__L34740 | 50 | 4049 |
| hTCRb-WT | 51 | 4050 |
| hTCRb-S57C-opt1 | 52 | 4051 |
| hTCRb-KACIAH | 53 | 4052 |
| hTCRb-opt2 | 54 | 4053 |
| hTCRb-KAIAH | 55 | 4054 |
| hTCRb-R79G | 56 | 4055 |
| hTCRbECD-CD3zECDTMCP-opt | 57 | 4056 |
| preTCRa__gb__U38996.1 | 58 | 4057 |
| preTCRa | 59 | 4058 |
| preTCRa-del48 | 60 | 4059 |
| hTCR-gamma__M27331.1 | 61 | 4060 |
| hTCR-Gamma-Opt | 62 | 4061 |
| hTCR-Delta | 63 | 4062 |
| hTCR-Delta-Opt | 64 | 4063 |
| CD3zECDTM-opt | 65 | 4064 |
| CD3zCP-opt | 66 | 4065 |
| CD3zECDTMCP-opt | 67 | 4066 |
| CD28-CP-opt | 68 | 4067 |
| 41BB-CP-opt | 69 | 4068 |
| CD3e-CP-opt | 70 | 4069 |
| CD3zECDTM-opt2 | 71 | 4070 |
| CD3zCP-opt2 | 72 | 4071 |
| CD3zECDTMCP-opt2 | 73 | 4072 |
| CD28-CP-opt2 | 74 | 4073 |
| 41BB-CP-opt2 | 75 | 4074 |
| CD3zECDTM-28z-opt | 76 | 4075 |
| CD3zECDTM-BBz-opt | 77 | 4076 |
| CD3zECDTM-28z-opt2 | 78 | 4077 |
| CD3zECDTM-BBz-opt2 | 79 | 4078 |
| F2A | 80 | 4079 |
| T2A | 81 | 4080 |
| T2A | 82 | 4081 |
| P2A | 83 | 4082 |
| P2a-variant | 84 | 4083 |
| E2A | 85 | 4084 |
| SGSG | 86 | 4085 |
| SGSG | 87 | 4086 |
| FURINE-CLEAVAGE-SITE | 88 | 4087 |
| FURINE-CLEAVAGE-SITE | 89 | 4088 |
| FURINE-CLEAVAGE-SITE | 90 | 4089 |
| PuroR__Variant-(PAC) | 91 | 4090 |
| BlastR | 92 | 4091 |
| CNB30 | 93 | 4092 |
| GMCSF-SP-tEGFR | 94 | 4093 |
| tEGFRviii | 95 | 4094 |
| tCD19 | 96 | 4095 |
| tBCMA | 97 | 4096 |
| hCD8-Hinge-TM | 98 | 4097 |
| hCD8-Hinge-TM-BBz | 99 | 4098 |
| hCD8TM-Hinge-BB | 100 | 4099 |
| CD3z-cytosolic-domain | 101 | 4100 |
| CD3z-cytosolic-domain | 102 | 4101 |
| CD28-Hinge-TM-cytosolic-domain | 103 | 4102 |
| Myr-MYD88-CD40-Fv'-Fv | 104 | 4103 |
| IL12F | 105 | 4104 |
| 41BB-L | 106 | 4105 |
| CD40L | 107 | 4106 |
| K13 | 108 | 4107 |
| MC159 | 109 | 4108 |
| cFLIP-L/MRIT-alpha | 110 | 4109 |
| cFLIP-p22 | 111 | 4110 |
| FKBP-K13 | 112 | 4111 |
| FKBPX2-K13 | 113 | 4112 |
| HTLV1-TAX | 114 | 4113 |
| HTLV2-TAX | 115 | 4114 |
| HTLV2-TAX-RS | 116 | 4115 |
| icaspase-9 | 117 | 4116 |
| HIV-1 Vif | 118 | 4117 |

TABLE 6

SEQUENCE LISTING OF DIFFERENT CAR classes based on the BCMA-Am06-HL antigen binding domain. The CAR type and accessory module(s) are also shown. CAR class 16 and 17 represent one chain of a double chain SIR and show biological activity only when co-expressed with their complementary chain (i.e., CAR class 18 and 19, respectively). CAR classes 13-15 (single chain SIR) show only weak activity.

| CAR Class | SEQ ID (DNA) | SEQ ID (PRT) | NAME | CAR TYPE | Accessory Module |
|---|---|---|---|---|---|
| CAR Class 1 | 377 | 4340 | CD8SP-BCMA-Am06-HL-vL-V5-[hTCRb-KACIAH]-F-P2A-SP-BCMA-Am06-HL-vH-Myc-[hTCRa-CSDVP]-F-F2A-PAC | Double chain SIR | PAC |
| CAR Class 2 | 378 | 4341 | CD8SP-BCMA-Am06-HL-vL-V5-[hTCRb-KACIAH]-F-P2A-SP-BCMA-Am06-HL-vH-Myc-[preTCRa-Del48]-F-F2A-PAC | Double chain SIR | PAC |
| CAR Class 3 | 379 | 4342 | CD8SP-V5-[hTCRb-KACIAH]-F-P2A-CD8SP-BCMA-Am06-HL-vL-Gly-Ser-Linker-BCMA-Am06-HL-vH-Myc-[hTCRa-CSDVP]-F-F2A-PAC | One and half chain SIR | PAC |

TABLE 6-continued

SEQUENCE LISTING OF DIFFERENT CAR classes based on the BCMA-Am06-HL antigen binding domain. The CAR type and accessory module(s) are also shown. CAR class 16 and 17 represent one chain of a double chain SIR and show biological activity only when co-expressed with their complementary chain (i.e., CAR class 18 and 19, respectively). CAR classes 13-15 (single chain SIR) show only weak activity.

| CAR Class | SEQ ID (DNA) | SEQ ID (PRT) | NAME | CAR TYPE | Accessory Module |
|---|---|---|---|---|---|
| CAR Class 4 | 380 | 4343 | CD8SP-V5-[hTCRb-KACIAH]-F-P2A-CD8SP-BCMA-Am06-HL-vL-Gly-Ser-Linker-BCMA-Am06-HL-vH-Myc4-[preTCRa-Del48]-F-F2A-PAC | One and half chain SIR | PAC |
| CAR Class 5 | 381 | 4344 | CD8SP-MYC-[hTCRa-T48C-opt1]-F-F2A-SP-BCMA-Am06-HL-vL-Gly-Ser-Linker-BCMA-Am06-HL-vH-V5-[hTCRb-S57C-opt1]-F-P2A-PAC | Double chain SIR | PAC |
| CAR Class 6 | 382 | 4345 | CD8SP-BCMA-Am06-HL-vL-V5-[hTCRb-S57C-opt]-F-P2A-SP-BCMA-Am06-HL-vH-Myc-[hTCRa-T48C-opt]-F-F2A-PAC | Double chain SIR | PAC |
| CAR Class 7 | 383 | 4346 | CD8SP-BCMA-Am06-HL-vL-[hTCRb-opt2] -F-P2A-SP-BCMA-Am06-HL-vH-[hTCRa-opt2]-F-F2A-PAC | Double chain SIR | PAC |
| CAR Class 8 | 384 | 4347 | CD8SP-BCMA-Am06-HL-vL-[hTCRb-opt2]-F-P2A-SP-BCMA-Am06-HL-vH-Myc-[preTCRa-Del48]-F-F2A-PAC | Double chain SIR | PAC |
| CAR Class 9 | 385 | 4348 | CD8SP-[hTCRb-opt2]-F-P2A-CD8SP-BCMA-Am06-HL-vL-Gly-Ser-Linker-BCMA-Am06-HL-vH-Myc4-[preTCRa-Del48]-F-F2A-PAC | One and half chain SIR | PAC |
| CAR Class 10 | 386 | 4349 | CD8SP-BCMA-Am06-HL-vL-V5-[hTCRg1-opt]-F-P2A-SP-BCMA-Am06-HL-vH-Myc-[hTCRd-opt]-F-F2A-PAC | Double chain SIR | PAC |
| CAR Class 11 | 387 | 4350 | CD8SP-V5-[hTCRg1-opt]-F-P2A-CD8SP-BCMA-Am06-HL-vL-Gly-Ser-Linker-BCMA-Am06-HL-vH-Myc-[hTCRd-opt]-F-F2A-PAC | One and half chain SIR | PAC |
| CAR Class 12 | 388 | 4351 | CD8SP-G4Sx2-[hTCRa-S61R-opt]-F-F2A-SP-BCMA-Am06-HL-vL-Gly-Ser-Linker-BCMA-Am06-HL-vH-G4Sx2-[hTCRb-R79G-opt]-F-P2A-PAC | One and half chain SIR | PAC |
| CAR Class 13 | 389 | 4352 | CD8SP-BCMA-Am06-HL-vL-Gly-Ser-Linker-BCMA-Am06-HL-vH-[hTCRa-SDVP]-F-F2A-PAC | Single Chain SIR | PAC |
| CAR Class 14 | 390 | 4353 | CD8SP-BCMA-Am06-HL-vL-Gly-Ser-Linker-BCMA-Am06-HL-vH-[hTCRb-KAIAH]-F-P2A-PAC | Single Chain SIR | PAC |
| CAR Class 15 | 391 | 4354 | CD8SP-BCMA-Am06-HL-vL-Gly-Ser-Linker-BCMA-Am06-HL-vH-Myc4-[preTCRa-Del48]-F-F2A-PAC | Single Chain SIR | PAC |
| CAR Class 16 | 392 | 4355 | CD8SP-BCMA-Am06-HL-vL-V5-[hTCRb-S57C-opt]-F-P2A-PAC | One chain of a double chain SIR | PAC |
| CAR Class 17 | 393 | 4356 | CD8SP-BCMA-Am06-HL-vL-V5-[hTCRb-S57C-opt] | One chain of a double chain SIR | |
| CAR Class 18 | 394 | 4357 | IgHSP-BCMA-Am06-HL-vH-Myc-[hTCRa-T48C-opt]-F-F2A-BlastR | One chain of a double chain SIR | |
| CAR Class 19 | 395 | 4358 | IgHSP-BCMA-Am06-HL-vH-Myc-[hTCRa-T48C-opt] | One chain of a double chain SIR | |
| CAR Class 20 | 396 | 4359 | CD8SP-BCMA-Am06-HL-vL-Gly-Ser-Linker-BCMA-Am06-HL-vH-Myc-CD8TM-BBz | CAR II | |
| CAR Class 21 | 397 | 4360 | CD8SP-BCMA-Am06-HL-vH-Gly-Ser-Linker-vL-Myc-CD8TM-BBz | CAR II | |
| CAR Class 22 | 398 | 4361 | CD8SP-BCMA-Am06-HL-vL-Gly-Ser-Linker-BCMA-Am06-HL-vH-Myc-CD8TM-z-P2A-K13-FLAG-T2A-PAC | CAR 1 | K13 and PAC |
| CAR Class 23 | 399 | 4362 | CD8SP-BCMA-Am06-HL-vL-[hTCRa-CSDVP]-F-F2A-SP-BCMA-Am06-HL-vH-[hTCRb-KACIAH]-F-P2A-Xba-PAC | Double chain SIR | PAC |
| CAR Class 24 | 400 | 4363 | CD8SP-BCMA-Am06-HL-vL-PG4SP-v2-[hTCRb-KACIAH]-F-P2A-SP-BCMA-Am06-HL-vH-PG4SP-[hTCRa-CSDVP]-F-F2A-PAC | Double chain SIR | PAC |

TABLE 6-continued

SEQUENCE LISTING OF DIFFERENT CAR classes based on the BCMA-Am06-HL antigen binding domain. The CAR type and accessory module(s) are also shown. CAR class 16 and 17 represent one chain of a double chain SIR and show biological activity only when co-expressed with their complementary chain (i.e., CAR class 18 and 19, respectively). CAR classes 13-15 (single chain SIR) show only weak activity.

| CAR Class | SEQ ID (DNA) | SEQ ID (PRT) | NAME | CAR TYPE | Accessory Module |
|---|---|---|---|---|---|
| CAR Class 25 | 401 | 4364 | CD8SP-BCMA-Am06-HL-vL-E-Coil-[hTCRb-KACIAH]-F-P2A-SP-BCMA-Am06-HL-vH-K-Coil-[hTCRa-CSDVP]-F-F2A-PAC | Double chain SIR | PAC |
| CAR Class 26 | 402 | 4365 | CD8SP-BCMA-Am06-HL-vL-EAAAK-[hTCRb-KACIAH]-F-P2A-SP-BCMA-Am06-HL-vH-EAAAK-v2-[hTCRa-CSDVP]-F-F2A-PAC | Double chain SIR | PAC |
| CAR Class 27 | 403 | 4366 | CD8SP-BCMA-Am06-HL-vL-V5-[hTCRb-KACIAH]-F-P2A-SP-BCMA-Am06-HL-vH-Myc4-[hTCRa-CSDVP]-F-F2A-PAC | Double chain SIR | PAC |
| CAR Class 28 | 404 | 4367 | CD8SP-BCMA-Am06-HL-vL-Myc2-[hTCRb-KACIAH]-F-P2A-SP-BCMA-Am06-HL-vH-Myc4-[hTCRa-CSDVP]-F-F2A-PAC | Double chain SIR | PAC |
| CAR Class 29 | 405 | 4368 | CD8SP-BCMA-Am06-HL-vL-[hTCRb-KACIAH]-F-P2A-SP-BCMA-Am06-HL-vH-[hTCRa-CSDVP]-F-F2A-PAC | Double chain SIR | PAC |
| CAR Class 30 | 406 | 4369 | CD8-BCMA-Am06-HL-vL-IgCL-CD3zECDTMCP-opt-F-P2A-SP-Bst-BCMA-Am06-HL-vH-IgG1-CH1-CD3zECDTMCP-opt2-F-F2A-PAC | zSIR | PAC |
| CAR Class 31 | 407 | 4370 | CD8SP-BCMA-Am06-HL-vL-[hTCRbECD-Bam-CD3zECDTMCP-opt]-F-P2A-SP-BCMA-Am06-HL-vH-[hTCRaECD-Kpn-CD3zECDTMCP-opt2] | zSIR | |
| CAR Class 32 | 408 | 4371 | CD8SP-BCMA-Am06-HL-vL-[hTCRb-KAC-ECD-Bam-CD3zECDTMCP-opt]-F-P2A-SP-BCMA-Am06-HL-vH-[hTCRa-CSDVP-ECD-Kpn-CD3zECDTMCP-opt2] | SIR | |
| CAR Class 33 | 409 | 4372 | CD8SP-BCMA-Am06-HL-vL-V5-[hTCRbECD-Bam-CD3zECDTMCP-opt]-F-P2A-SP-BCMA-Am06-HL-vH-Myc-[hTCRaECD-Kpn-CD3zECDTM-28z-opt2] | SIR | PAC |
| CAR Class 34 | 410 | 4373 | CD8SP-BCMA-Am06-HL-vL-V5-[hTCRbECD-Bam-CD3zECDTM-28z-opt]-F-P2A-SP-BCMA-Am06-HL-vH-Myc-[hTCRaECD-Kpn-CD3zECDTM-28z-opt2] | SIR | |
| CAR Class 35 | 411 | 4374 | CD8SP-BCMA-Am06-HL-vL-V5-[hTCRbECD-Bam-CD3zECDTMCP-opt]-F-P2A-SP-BCMA-Am06-HL-vH-Myc4-[hTCRaECD-Kpn-CD3zECDTM-BBz-opt2] | SIR | |
| CAR Class 36 | 412 | 4375 | CD8SP-BCMA-Am06-HL-vL-V5-[hTCRbECD-Bam-CD3zECDTM-BBz-opt]-F-P2A-SP-BCMA-Am06-HL-vH-Myc4-[hTCRaECD-Kpn-CD3zECDTM-BBz-opt2] | SIR | |
| CAR Class 37 | 413 | 4376 | CD8-BCMA-Am06-HL-vL-IgCL-Xho-CD3zECDTMCP-opt-F-P2A-Spe-SP-Bst-BCMA-Am06-HL-vH-IgG1-CH1-Mlu-CD3zECDTMCP-opt2-F-F2A-PAC-DeltaWPRE | zSIR | |
| CAR Class 38 | 414 | 4377 | CD8SP-BCMA-Am06-HL-(vL-vH)-Myc-z-P2A-hNEMO-K277A-Flag-T2A-PAC | CAR I | hNEMO-K277A-Flag and PAC |
| CAR Class 39 | 415 | 4378 | CD8SP-BCMA-Am06-HL-(vL-vH)-CD3e-ECDTMCP-opt2-P2A-hNEMO-K277A-Flag-T2A-PAC | TFP | hNEMO-K277A-Flag and PAC |
| CAR Class 40 | 416 | 4379 | CD8SP-BCMA-Am06-HL-(vL-vH)-CD3d-ECDTMCP-opt2-P2A-hNEMO-K277A-Flag-T2A-PAC | TFP | hNEMO-K277A-Flag and PAC |
| CAR Class 41 | 417 | 4380 | CD8SP-BCMA-Am06-HL-(vL-vH)-CD3g-ECDTMCP-opt2-P2A-hNEMO-K277A-Flag-T2A-PAC | TFP | hNEMO-K277A-Flag and PAC |
| CAR Class 42 | 418 | 4381 | CD8SP-BCMA-Am06-HL-(vL-vH)-CD3z-ECDTMCP-opt2-P2A-hNEMO-K277A-Flag-T2A-PAC | TFP | hNEMO-K277A-Flag and PAC |
| CAR Class 43 | 419 | 4382 | CD8SP-BCMA-Am06-HL-vL-[IgCL-TCRg-6MD]-F-P2A-SP-BCMA-Am06-HL-vH-[IgG1-CH1-TCRd-6MD]-F-F2A-hNEMO-K277A | Ab-TCR | hNEMO-K277A-Flag |

TABLE 6-continued

SEQUENCE LISTING OF DIFFERENT CAR classes based on the BCMA-Am06-HL antigen binding domain. The CAR type and accessory module(s) are also shown. CAR class 16 and 17 represent one chain of a double chain SIR and show biological activity only when co-expressed with their complementary chain (i.e., CAR class 18 and 19, respectively). CAR classes 13-15 (single chain SIR) show only weak activity.

| CAR Class | SEQ ID (DNA) | SEQ ID (PRT) | NAME | CAR TYPE | Accessory Module |
|---|---|---|---|---|---|
| CAR Class 44 | 420 | 4383 | CD8SP-BCMA-Am06-HL-vL-[IgCL-TCRb-IAH-6MD]-F-P2A-SP-BCMA-Am06-HL-vH-[IgG1-CH1-TCRa-SDVP-6MD]-F-F2A-hNEMO-K277A | Ab-TCR | hNEMO-K277A-Flag |
| CAR Class 45 | 421 | 4384 | CD8SP-BCMA-Am06-HL-(vH-vL)-CD3e-ECDTMCP-opt2-P2A-hNEMO-K277A-Flag-T2A-PAC | TFP | hNEMO-K277A-Flag and PAC |
| CAR Class 46 | 422 | 4385 | CD8SP-BCMA-Am06-HL-(vH-vL)-CD3d-ECDTMCP-opt2-P2A-hNEMO-K277A-Flag-T2A-PAC | TFP | hNEMO-K277A-Flag and PAC |
| CAR Class 47 | 423 | 4386 | CD8SP-BCMA-Am06-HL-(vH-vL)-CD3g-ECDTMCP-opt2-P2A-hNEMO-K277A-Flag-T2A-PAC | TFP | hNEMO-K277A-Flag and PAC |
| CAR Class 48 | 424 | 4387 | CD8SP-BCMA-Am06-HL-(vH-vL)-CD3z-ECDTMCP-opt2-P2A-hNEMO-K277A-Flag-T2A-PAC | TFP | hNEMO-K277A-Flag and PAC |
| CAR Class 49 | 425 | 4388 | CD8SP-BCMA-Am06-HL-vL-Xho-CD3zECDTMCP-opt-F-P2A-Spe-SP-BCMA-Am06-HL-vH-Mlu-CD3zECDTMCP-opt2-F-F2A-PAC | zSIR | PAC |
| CAR Class 50 | 12784 | 14528 | CD8SP-BCMA-Am06-vL-[hTCRb-S57C]-F-P2A-SP-BCMA-Am06-vH-[hTCRa-T48C] | Double chain SIR | |
| CAR Class 51 | 12785 | 14529 | CD8SP-BCMA-Am06-vL-[hTCRb-S57C]-F-P2A-SP-BCMA-Am06-vH-[hTCRa-T48C]-F-F2A-K13-opt | Double chain SIR | K13-vFLIP |
| CAR Class 52 | 12786 | 14530 | CD8SP-BCMA-Am06-vL-[hTCRa-T48C]-F-P2A-SP-BCMA-Am06-vH-[hTCRa-S57C] | Double chain SIR | |
| CAR Class 53 | 12787 | 14531 | CD8SP-BCMA-Am06-vL-[hTCRa-T48C]-F-P2A-SP-BCMA-Am06-vH-[hTCRa-S57C]-F-P2A-K13-opt | Double chain SIR | K13-vFLIP |

TABLE 7

SEQUENCE LISTING OF VARIOUS CAR CONSTRUCTS CONTAINING DIFFERENT ANTIGEN BINDING DOMAINS. THE ORDER OF DIFFERENT CAR CONSTRUCTS IS AS SHOWN IN TABLE 6 FOR BCMA-Am06-HL BASED CARs.

| | | | CARs | |
|---|---|---|---|---|
| | Antigen Target | Antigen Binding Domain | SEQ ID NO (DNA) | SEQ ID NO (PRT) |
| 1 | BCMA | BCMA-Am14-HL | 475-523 | 4438-4486 |
| 2 | BCMA | BCMA-Am08-HL | 426-474 | 4389-4437 |
| 3 | BCMA | BCMA-Am06-HL | 377-425; 12784-12787 | 4340-4388; 14528-14531 |
| 4 | CD19 | hu-CAT18-1-HL | 867-915 | 4830-4871 |
| 5 | CD19 | CAT17-HL | 818-866 | 4781-4829 |
| 6 | CD22 | hu-HA22-1 | 1112-1160 | 5068-5115 |
| 7 | CD19 | CD19-DART1 | 916-964 | 4872-4920 |
| 8 | CD20 | hu-Ubli-1-v4 | 1063-1111 | 5019-5067 |
| 9 | Hu | Hu-IntB7-MMG49 | 2533-2581 | 6489-6537 |
| 10 | BCMA | BCMA-BB-CAR02 | 524-572 | 4487-4535 |
| 11 | Her2 | Her2-169 | 2288-2336 | 6244-6292 |
| 12 | Her2 | Her2-XMT-1520 | 2435-2483 | 6391-6439 |
| 13 | Her2 | Her2-XMT-1518 | 2386-2434 | 6342-6390 |
| 14 | Her2 | Her2-huMab4D5-D98W | 2337-2385 | 6293-6341 |
| 15 | TSHR | TSHR-hu-3BD10 | 3611-3659 | 7567-7615 |
| 16 | PSMA | PSMA-83A12-HL-AM | 3317-3365 | 7273-7321 |
| 17 | PSMA | PSMA-76-HL-AM | 3268-3316 | 7224-7272 |
| 18 | PSMA | hu106mPSMA-4-HL | 3219-3267 | 7175-7223 |
| 19 | MSLN | MSLN-3-HL-AM | 2729-2777 | 6685-6733 |
| 20 | MSLN | MSLN-5-HL | 2778-2826 | 6734-6782 |
| 21 | EGFRviii | EGFRviii-2-AM-HL | 1651-1699 | 5607-5655 |
| 22 | EGFRviii | EGFRviii-H2M1863N2-HL | 1749-1797 | 5705-5753 |
| 23 | EGFRviii | EGFRviii-H2M1915N-HL | 1798-1846 | 5754-5802 |
| 24 | EGFRviii | EGFRviii-131-2 | 1700-1748 | 5656-5704 |

TABLE 7-continued

SEQUENCE LISTING OF VARIOUS CAR CONSTRUCTS CONTAINING DIFFERENT ANTIGEN BINDING DOMAINS. THE ORDER OF DIFFERENT CAR CONSTRUCTS IS AS SHOWN IN TABLE 6 FOR BCMA-Am06-HL BASED CARs.

| | | | CARs | |
|---|---|---|---|---|
| | Antigen Target | Antigen Binding Domain | SEQ ID NO (DNA) | SEQ ID NO (PRT) |
| 25 | DLL3 | DLL3-AM6-HL | 1553-1601 | 5509-5557 |
| 26 | DLL3 | DLL3-AM14-HL | 1602-1650 | 5558-5606 |
| 27 | Nectin 4 | Nectin4-66-HL | 3072-3120 | 7028-7076 |
| 28 | MSLN | MSLN-237-HL | 2827-2875 | 6783-6831 |
| 29 | MSLN | MSLN-HuAM15 | 2925-2973 | 6881-6929 |
| 30 | MSLN | MSLN76923-HL | 2876-2924 | 6832-6880 |
| 31 | PRLR | PRLR-CN | 3121-3169 | 7077-7125 |
| 32 | Muc17 | Muc17-11-CN | 3023-3071 | 6979-7027 |
| 33 | CD19 | CD19-AM1 | 769-817 | 4732-4780 |
| 34 | CD19 | CD19-9B7 | 720-768 | 4683-4731 |
| 35 | CD20 | CD20-HL | 1014-1062 | 4970-5018 |
| 36 | CD70 | CD70-HL-AM13 | 1210-1258 | 5166-5214 |
| 37 | CDH19 | CDH19-USC1-HLv4 | 1308-1356 | 5264-5312 |
| 38 | CDH19 | CDH19-USC2-HL | 1357-1405 | 5313-5361 |
| 39 | C16ORF54 | C16ORF54-USC1-v4 | 671-719 | 4634-4682 |
| 40 | VISTA | huVISTA-USC1-v4 | 3807-3855 | 7763-7811 |
| 41 | VISTA | huVISTA-JJ-USC2-v4 | 3758-3806 | 7714-7762 |
| 42 | GPC3 | GPC3-USC1-HL-V4 | 2141-2189 | 6097-6145 |
| 43 | GPC3 | GPC3-USC2-HL-V4 | 2190-2238 | 6146-6194 |
| 44 | PRLR | PRLR-USC2-HL-V4 | 3170-3218 | 7126-7174 |
| 45 | Muc5Ac | Muc5Ac-USC1-HL-V4 | 2974-3022 | 6930-6978 |
| 46 | FCRH5 | FCRH5-USC1-HL-V4 | 1994-2042 | 5950-5998 |
| 47 | LYPD1 | LYPD1-HL-V4 | 2631-2679 | 6587-6635 |
| 48 | EMR2 | EMR2-USC1-V4 | 1847-1895 | 5803-5851 |
| 49 | EMR2 | EMR2-USC2-V4 | 1896-1944 | 5852-5900 |
| 50 | EMR2 | mEMR2-USC3-V4 | 1945-1993 | 5901-5949 |
| 51 | gPNMB | m-gPNMB-USC1-HL-v4 | 2239-2287 | 6195-6243 |
| 52 | RNF43 | RNF43-USC1-HL4 | 3366-3414 | 7322-7370 |
| 53 | RNF43 | RNF43-USC2-HL4 | 3415-3463 | 7371-7419 |
| 54 | CD44v6 | CD44v6-USC1-HL4 | 1161-1209 | 5117-5165 |
| 55 | Robo4 | Robo4-USC1 | 3464-3512 | 7420-7468 |
| 56 | CEA | CEA-USC1-HL4 | 1406-1454 | 5362-5410 |
| 57 | Her3 | Her3-USC1-HL4 | 2484-2532 | 6440-6488 |
| 58 | FOLR1 | FOLR1-USC1-HL4 | 2043-2091 | 5999-6047 |
| 59 | FOLR1 | FOLR1-USC2-HL4 | 2092-2140 | 6048-6096 |
| 60 | CLDN6 | CLDN6-USC1-LH4 | 1455-1503 | 5411-5459 |
| 61 | CLDN6 | CLDN6-USC2-LH4 | 1504-1552 | 5460-5508 |
| 62 | MMP16 | hMMP16-USC-1-LH4 | 2680-2728 | 6636-6684 |
| 63 | UPK1B | hUPK1B-USC1-LH4 | 3660-3708 | 7616-7664 |
| 64 | UPK1B | hUPK1B-USC2-LH4 | 3709-3757 | 7665-7713 |
| 65 | BMPR1B | hBMPR1B-USC1-LH4 | 573-621 | 4536-4584 |
| 66 | BMPR1B | hBMPR1B-USC2-LH4 | 622-670 | 4585-4633 |
| 67 | Ly6E | Ly6E-USC1-HL4 | 2582-2630 | 6538-6586 |
| 68 | STEAP1 | STEAP1-USC1-HL4 | 3513-3561 | 7469-7517 |
| 69 | CD79b | CD79b-USC1-LH4 | 1259-1307 | 5215-5263 |
| 70 | WISP1 | hu-UISP1-USC1-LH4 | 3856-3904 | 7812-7860 |
| 71 | WISP1 | hu-UISP1-USC2-LH4 | 3905-3953 | 7861-7909 |
| 72 | SLC34A2 | huMX35-LH4 | 3562-3610 | 7518-7566 |
| 73 | CD19 | hu-CD19-USC1-LH4 | 965-1013 | 4921-4969 |
| 74 | CD22 | CD22-HA22 | 8730-8778 | 10361-10409 |
| 75 | STEAP1 | STEAP1-hu120 | 9563-9611 | 11194-11242 |
| 76 | Liv1 | hLiv1-mAb2 | 9318-9366 | 10949-10997 |
| 77 | Nectin 4 | hu-Nectin4-mAb1 | 9465-9513 | 11096-11144 |
| 78 | Cripto | hu-Cripto-L1H2 | 8877-8925 | 10508-10556 |
| 79 | gpA33 | hu-gpA33 | 9024-9072 | 10655-10703 |
| 80 | ROR1 | ROR1-DART4 | 9514-9562 | 11145-11193 |
| 81 | BCMA | BCMA-FS | 8191-8239 | 9822-9870 |
| 82 | BCMA | BCMA-PC | 8289-8337 | 9920-9968 |
| 83 | BCMA | BCMA-AJ | 8093-8141 | 9724-9772 |
| 84 | BCMA | BCMA-NM | 8240-8288 | 9871-9919 |
| 85 | BCMA | BCMA-TS | 8436-8484 | 10067-10115 |
| 86 | BCMA | BCMA-PP | 8338-8386 | 9969-10017 |
| 87 | BCMA | BCMA-RD | 8387-8435 | 10018-10066 |
| 88 | BCMA | BCMA-BB-CAR02 | 8142-8190 | 9773-9821 |
| 89 | CLL1 | CLL1-24C8 | 8828-8876 | 10459-10507 |
| 90 | CLL1 | CLL1-24C1 | 8779-8827 | 10410-10458 |
| 91 | FLT3 | FLT3-10E3 | 8975-9023 | 10606-10654 |
| 92 | FLT3 | FLT3-8B5 | 8926-8974 | 10557-10605 |
| 93 | IL1RAP | IL1RAP-IAPB57 | 9171-9219 | 10802-10850 |
| 94 | IL1RAP | IL1RAP-IAPB63 | 9220-9268 | 10851-10899 |

TABLE 7-continued

SEQUENCE LISTING OF VARIOUS CAR CONSTRUCTS CONTAINING DIFFERENT ANTIGEN BINDING DOMAINS. THE ORDER OF DIFFERENT CAR CONSTRUCTS IS AS SHOWN IN TABLE 6 FOR BCMA-Am06-HL BASED CARs.

| | | | CARs | |
|---|---|---|---|---|
| | Antigen Target | Antigen Binding Domain | SEQ ID NO (DNA) | SEQ ID NO (PRT) |
| 95 | IL1RAP | hu-IL1RAP-CANO4 | 9269-9317 | 10900-10948 |
| 96 | MSLN | MSLN-7D9-v3 | 9367-9415 | 10998-11046 |
| 97 | MSLN | MSLN-hu22A10 | 9416-9464 | 11047-11095 |
| 98 | CD19 | hu-Bu13 | 8632-8680 | 10263-10311 |
| 99 | BST1 | hu-BST1-A1 | 8485-8533 | 10116-10164 |
| 100 | BST1 | hu-BST1-A2 | 8534-8582 | 10165-10212 |
| 101 | BST1 | hu-BST1-A3 | 8583-8631 | 10213-10262 |
| 102 | Her2 | Her2-XMT-1519 | 9122-9170 | 10753-10801 |
| 103 | Her2 | Her2-XMT-1517 | 9073-9121 | 10704-10752 |
| 104 | CD133 | CD133-RW03 | 11312-11360 | 11472-11520 |
| 105 | CD133 | CD133-W6B3H10 | 11361-11409 | 11521-11569 |
| 106 | CD133 | CD133-293AC1C3B9 | 11410-11458 | 11570-11618 |
| 107 | IL113Ra2 | hu-IL13Ra2-mAb47 | 14113-14165 | 15857-15909 |
| 108 | CD22 | CD22-INO | 13424-13476 | 15168-15220 |
| 109 | CD22 | CD22-CELL4 | 13106-13158 | 14850-14902 |
| 110 | CD22 | CD22-CELL13 | 13212-13264 | 14956-15008 |
| 111 | CD22 | CD22-CELL7 | 13159-13211 | 14903-14955 |
| 112 | CD22 | CD22-VM1011 | 13689-13741 | 15433-15485 |
| 113 | CD22 | CD22-RAB-4120 | 13636-13688 | 15380-15432 |
| 114 | CD22 | CD22-Med-12C5-HL | 13477-13529 | 15221-15273 |
| 115 | CD22 | CD22-Med-19A3 | 13583-13635 | 15327-15379 |
| 116 | CD22 | CD22-Med-16F7 | 13530-13582 | 15274-15326 |
| 117 | CD22 | hu-RFB4 | 14166-14218 | 15910-15962 |
| 118 | BCMA | BCMA-mJ22-9 | 13053-13105 | 14797-14849 |
| 119 | BCMA | BCMA-huJ22-10 | 12947-12999 | 14691-14743 |
| 120 | CD22 | CD22-hu-HA22-2 | 13371-13423 | 15115-15167 |
| 121 | CD19 | huCD19-USC3 | 14060-14112 | 15804-15856 |
| 122 | CD22 | BCMA-hu72 | 12788-12840 | 14532-14584 |
| 123 | MPL | hu-161-3 | 13795-13847 | 15539-15591 |
| 124 | BAFF-R | hu-BAFFR-USC90 | 13954-14006 | 15698-15750 |
| 125 | BAFF-R | hu-BAFFR-USC55 | 13901-13953 | 15645-15697 |
| 126 | BAFF-R | hu-BAFFR-MOR6654 | 13848-13900 | 15592-15644 |
| 127 | CD19 | CD19-hu-mROO5-1 | 14007-14059 | 15751-15803 |
| 128 | CD22 | CD22-h10F4v2 | 13265-13317 | 15009-15061 |
| 129 | CD22 | CD22-HA22 | 13318-13370 | 15062-15114 |
| 130 | MPL | hu-161-2 | 13742-13794 | 15486-15538 |
| 131 | MSLN | MSLN-hu22A10 | 14325-14377 | 16069-16021 |
| 132 | MSLN | MSLN-7D9-HL | 14272-14324 | 16016-16068 |
| 133 | MSLN | MSLN-5 | 14219-14271 | 15963-16015 |
| 134 | BCMA | BCMA-huC13-F12 | 12894-12946 | 14638-14690 |
| 135 | BCMA | BCMA-huC12A3-L3H3 | 12841-12893 | 14585-14637 |
| 136 | BCMA | BCMA-J6M0 | 13000-13052 | 14744-14796 |

TABLE 8

Exemplary zSIR, SIR and miscellaneous constructs

| SEQ ID (DNA) | SEQ ID (PRT) | NAME |
|---|---|---|
| 3955 | 7955 | CD8SP-hCD19-EUK5-13-vL-IgCL-Bam-CD3zECDTMCP-opt-F-P2A-SP-Bst-hCD19-EUK5-13-vH-IgG1-CH1-KPN-CD3zECDTMCP-opt2-F-F2A-PAC |
| 3956 | 7956 | CD8-hCD19-EUK5-13-vL-IgCL-Xho-CD3zECDTMCP-opt-F-P2A-Spe-SP-Bst-hCD19-EUK5-13-vH-IgG1-CH1-Mlu-CD3zECDTMCP-opt2-F-F2A-PAC |
| 3957 | 7957 | CD8SP-hCD19-EUK5-13-vL-Xho-CD3zECDTMCP-opt-F-P2A-Spe-SP-hCD19-EUK5-13-vH-Mlu-CD3zECDTMCP-opt2-F-F2A-PAC |
| 3958 | 7958 | |
| 3959 | 7959 | CD8SP-FMC63-vL-Xho-CD3zECDTMCP-opt-F-P2A-Spc-SP-FMC63-vH-Mlu-CD3zECDTMCP-opt2-F-F2A-PAC |

TABLE 8-continued

Exemplary zSIR, SIR and miscellaneous constructs

| SEQ ID (DNA) | SEQ ID (PRT) | NAME |
|---|---|---|
| 3960 | 7960 | hCD19-Bu12-Xho-CD3zECDTMCP-opt-F-P2A-Pac |
| 3961 | 7961 | CD8SP-CD19Bu12-scFv-Xho-CD3zECDTMCP-opt-F-P2A-SP-CD19MM-scFv-Mlu-CD3zECDTMCP-opt2-F-F2A-PAC |
| 3962 | 7962 | CD8SP-CD19Bu12-scFv-Xho-CD3zECDTMCP-opt-F-P2A-SP-CD123-DART2-scFv-Mlu-CD3zECDTMCP-opt2-F-F2A-PAC |
| 3963 | 7963 | CD8SP-CD19Bu12-scFv-Xho-CD3zECDTMCP-opt-F-P2A-SP-CD20-2F2-scFv-Mlu-CD3zECDTMCP-opt2-F-F2A-PAC |
| 3964 | 7964 | CD8SP-CD19Bu12-scFv-Xho-CD3zECDTMCP-opt-F-P2A-SP-AFP-61-scFv-Mlu-CD3zECDTMCP-opt2-F-F2A-PAC |
| 3965 | 7965 | CD8SP-CD19Bu12-scFv-Xho-CD3zECDTMCP-opt-F-P2A-SP-CD22-h10F4v2-scFv-Mlu-CD3zECDTMCP-opt2-F-F2A-PAC |
| 3966 | 7966 | CD8SP-CD19Bu12-scFv-Xho-CD3zECDTMCP-opt-F-P2A-SP-hSC22-10-HL-scFv-Mlu-CD3zECDTMCP-opt2-F-F2A-PAC |
| 3967 | 7967 | CD8SP-CD19Bu12-scFv-Xho-CD3zECDTMCP-opt-F-P2A-SP-CD123-DART1-scFv-Mlu-CD3zECDTMCP-opt2-F-F2A-PAC |
| 3968 | 7968 | CD8SP-CD19Bu12-scFv-Xho-CD3zECDTMCP-opt-F-P2A-SP-WT1-Ab5-scFv-Mlu-CD3zECDTMCP-opt2-F-F2A-PAC |
| 3969 | 7969 | CD8SP-CD19-USC2-vL-[hTCRb-KACIAH]-F-P2A-SP-CD19-USC2-vH-[hTCRa-CSDVP]-F-F2A-PAC |
| 3971 | 7971 | CD8SP-BCMA-Am06-HL-vL-[CD3zECDTM-28z-opt]-F-P2A-SP-BCMA-Am06-HL-vH-[CD3zECDTM-28z-opt2] |
| 3972 | 7972 | CD8SP-BCMA-Am06-HL-vL-[CD3z.ECDTM-BBz-opt]-F-P2A-SP-BCMA-Am06-HL-vH-[CD3zECDTM-BBz-opt2] |
| 16311 | 16335 | CD8SP-FMC63-BBz |
| 16312 | 16336 | CD8SP-MSLN-hu22A10-BBz |
| 16313 | 16337 | CD8SP-MSLN-7D9-HL-BBz |
| 16314 | 16338 | CD8SP-MSLN-5-HL-BBz |
| 16315 | 16339 | CD8SP-MPL-hu-161-2-BBz |
| 16316 | 16340 | CD8SP-BCMA-huC13-F12-BBz |
| 16317 | 16341 | CD8SP-huCD19-mR005-1-BBz |
| 16318 | 16342 | CD8SP-huCD19-mR005-1-vL-[hTCRb-KACIAH]-F-P2A-SP-huCD19-mR005-1-vH-[hTCRa-CSDVP]-F-F2A-K13-opt |
| 16319 | 16343 | CD8SP-CD22-INO-vL-[hTCRb-S57C]-F-P2A-SP-CD22-INO-vH-[hTCRa-T48C]-F-F2A-PAC |
| 16320 | 16344 | CD8SP-CD22-hu-HA22-2-vL-[hTCRa-T48C]-F-P2A-SP-CD22-hu-HA22-2-vH-[hTCRa-S57C]-F-F2A-Pac |
| 16321 | 16345 | CD8SP-CD22-Mcd-12C5-HL-vH-[hTCRb-S57C]-F-P2A-SP-CD22-Mcd-12C5-HL-vL-[hTCRa-T48C]-F-F2A-PAC |
| 16322 | 16346 | CD8SP-hu-RFB4-vL-[hTCRb-S57C]-F-P2A-SP-hu-RFB4-vH-[hTCRa-T48C]-F-F2A-PAC |
| 16323 | 16347 | CD8SP-CD22-CELL7-vH-[hTCRb-S57C]-F-P2A-SP-CD22-CELL7-vL-[hTCRa-T48C]-F-F2A-PAC |
| 16324 | 16348 | CD8SP-CD22-HA22-vL-[hTCRb-S57C]-F-P2A-SP-CD22-HA22-vH-[hTCRa-T48C]-F-F2A-PAC |
| 16325 | 16349 | CD8SP-MSLN-7D9-HL-vH-[hTCRa-T48C]-F-P2A-SP-MSLN-7D9-HL-vL-[hTCRa-S57C] |

TABLE 8-continued

| Exemplary zSIR, SIR and miscellaneous constructs | | |
|---|---|---|
| SEQ ID (DNA) | SEQ ID (PRT) | NAME |
| 16326 | 16350 | CD8SP-MSLN-7D9-HL-vH-[hTCRb-S57C]-F-P2A-SP-MSLN-7D9-HL-vL-[hTCRa-T48C] |
| 16328 | 16351 | CD8SP-huCD19-mR005-1-(vL-vH)-CD3c-ECDTMCP-opt2-T2A-PAC |
| 16329 | 16352 | CD8SP-huCD19-mR005-1-(vL-vH)-CD3d-ECDTMCP-opt2-T2A-PAC |
| 16330 | 16353 | CD8SP-huCD19-mR005-1-vL-[hTCRb-KACIAH]-F-P2A-SP-huCDI9-mR005-l-vH-[hTCRa-CSDVP] |
| 16331 | 16354 | CD8SP-MSLN-hu22A10-vL-[hTCRb-KACIAH]-F-P2A-SP-MSLN-hu22A10-vH-[hTCRa-CSDVP]-F-F2A-K13-Opt |
| 16332 | 16355 | CD8SP-MSLN-hu22A10-vL-[hTCRb-KACIAH]-F-P2A-SP-MSLN-hu22A10-vH-[hTCRa-CSDVP] |
| 16333 | 16356 | CD8SP-MSLN-7D9-HL-vH-[hTCRb-KACIAH]-F-P2A-SP-MSLN-7D9-HL-vL-[hTCRa-CSDVP]-F-F2A-K13-opt |
| 16334 | 16357 | CD8SP-MSLN-7D9-HL-vH-[hTCRb-KACIAH]-F-P2A-SP-MSLN-7D9-HL-vL-[hTCRa-CSDVP] |
| 16361 | 16358 | CD8SP-MSLN-5-HL-vH-[hTCRa-CSDVP]-F-F2A-SP-MSLN-5-HL-vL-[hTCRb-KACIAH] |
| 16362 | 16359 | CD8SP-MSLN-7D9-HL-vH-[hTCRa-CSDVP]-F-F2A-SP-MSLN-7D9-HL-vL-[hTCRb-KACIAH] |
| 16363 | 16360 | CD8SP-MSLN-hu22A10-vL-[hTCRa-CSDVP]-F-F2A-SP-MSLN-hu22A10-vH-[hTCRb-KACIAH] |

TABLE 9

| Exemplary Vif constructs | | |
|---|---|---|
| SEQ ID (DNA) | SEQ ID (PRT) | NAME |
| 11243 | 11270 | HIV1-Vif |
| 11244 | 11271 | CD8SP-FMC63-(VL-vH)-Myc-BBz-T2A-PAC |
| 11245 | 11272 | CD8SP-FMC63-(vL-vH)-Myc-BBz-F-P2A-Vif-F-P2A-PAC |
| 11246 | 11273 | CD8SP-hu-CD19-USC1-LH4-vL-V5-[hTCRb-KACIAH]-F-P2A-SP-hu-CD19-USC1-LH4-vH-Myc-[hTCRa-CSDVP]-F-F2A-Vif |
| 11247 | 11274 | CD8SP-hu-CDI9-USC1-LH4-vL-V5-[hTCRb-KACIAH]-F-P2A-SP-hu-CD19-USC1-LH4-vH-Myc-[preTCRa-Del48]-F-F2A-Vif |
| 11248 | 11275 | CD8SP-V5-[hTCRb-KACIAH]-F-P2A-CD8SP-hu-CD19-USC1-LH4-vL-Gly-Ser-Linker-hu-CD19-USC1-LH4-vH-Myc-[hTCRa-CSDVP]-F-F2A-Vif |
| 11249 | 11276 | CD8SP-hu-CD19-USC1-LH4-vL-V5-[hTCRg1-opt]-F-P2A-SP-hu-CD19-USC1-LH4-vH-Myc-[hTCRd-opt]-F-F2A-Vif |

TABLE 9-continued

| Exemplary Vif constructs | | |
|---|---|---|
| SEQ ID (DNA) | SEQ ID (PRT) | NAME |
| 11250 | 11277 | CD8SP-V5-[hTCRg1-opt]-F-P2A-CD8SP-hu-CD19-USC1-LH4-vL-Gly-Ser-Linker-hu-CD19-USC1-LH4-vH-Myc-[hTCRd-opt]-F-F2A-Vif |
| 11251 | 11278 | CD8SP-hu-CD19-USC1-LH4-vL-Gly-Ser-Linker-hu-CD19-USC1-LH4-vH-Myc-CD8TM-z-P2A-K13-FLAG-T2A-Vif |
| 11252 | 11279 | CD8SP-hu-CD19-USC1-LH4-vL-[hTCRa-CSDVP]-F-F2A-SP-hu-CD19-USC1-LH4-vH-[hTCRb-KACIAH]-F-P2A-Vif |
| 11253 | 11280 | CD8-hu-CD19-USC1-LH4-vL-IgCL-Bam-CD3zECDTMCP-opt-F-P2A-Spe-SP-Bst-hu-CD19-USC1-LH4-VH-IgG1-CH1-KPN-CD3zECDTMCP-opt2-F-F2A-Xba-Vif |
| 11254 | 11281 | CD8-hu-CD19-USC1-LH4-vL-IgCL-Xho-CD3zECDTMCP-opt-F-P2A-Spe-SP-Bst-hu-CD19-USC1-LH4-vH-IgG1-CH1-Mlu-CD3zECDTMCP-opt2-F-F2A-Vif |

TABLE 9-continued

| Exemplary Vif constructs | | |
|---|---|---|
| SEQ ID (DNA) | SEQ ID (PRT) | NAME |
| 11255 | 11282 | CD8SP-hu-CD19-USC1-LH4-(vL-vH)-Myc-z-P2A-hNEMO-K277A-Flag-T2A-Vif |
| 11256 | 11283 | CD8SP-hu-CD19-USC1-LH4-(vL-vH)-CD3e-ECDTMCP-opt2-P2A-hNEMO-K277A-Flag-T2A-Vif |
| 11257 | 11284 | CD8SP-hu-CD19-USC1-LH4-(vL-vH)-CD3d-ECDTMCP-opt2-P2A-hNEMO-K277A-Flag-T2A-Vif |
| 11258 | 11285 | CD8SP-hu-CD19-USC1-LH4-(vL-vH)-CD3g-ECDTMCP-opt2-P2A-hNEMO-K277A-Flag-T2A-Vif |
| 11259 | 11286 | CD8SP-hu-CD19-USC1-LH4-(vL-vH)-CD3z-ECDTMCP-opt2-P2A-hNEMO-K277A-Flag-T2A-Vif |
| 11260 | 11287 | CD8SP-hu-CD19-USC1-LH4-vL-[IgCL-TCRg-6MD]-F-P2A-SP-hu-CD19-USC1-LH4-vH-[IgG1-CH1-TCRd-6MD]-F-F2A-Vif |
| 11261 | 11288 | CD8SP-hu-CD19-USC1-LH4-vL-[IgCL-TCRb-IAH-6MD]-F-P2A-SP-hu-CD19-USC1-LH4-vH-[IgG1-CH1-TCRa-SDVP-6MD]-F-F2A-Vif |
| 11262 | 11289 | CD8SP-hu-CD19-USC1-LH4-(vH-vL)-CD3e-ECDTMCP-opt2-P2A-Vif |
| 11263 | 11290 | CD8SP-hu-CD19-USC1-LH4-(vH-vL)-CD3d-ECDTMCP-opt2-P2A-hNEMO-K277A-Flag-T2A-Vif |
| 11264 | 11291 | CD8SP-hu-CD19-USC1-LH4-(vH-vL)-CD3g-ECDTMCP-opt2-P2A-hNEMO-K277A-Flag-T2A-Vif |
| 11265 | 11292 | CD8SP-hu-CD19-USC1-LH4-(vH-vL)-CD3z-ECDTMCP-opt2-P2A-hNEMO-K277A-Flag-T2A-Vif |
| 11266 | 11293 | CD8SP-hu-CD19-USC1-LH4-vL-Xho-CD3zECDTMCP-opt-F-P2A-Spe-Sp-CD19-USC1-LH4-vH-Mlu-CD3zECDTMCP-opt2-F-F2A-Vif |
| 11267 | 11294 | CD8SP-hu-CD19-USC1-LH4-vH-Gly-Ser-Linker-vL-Myc-CD8TM-BBz-2A-Vif |
| 11268 | | pLenti-EF1a-CD8SP-hu-CD19-USC1-LH4-vH-Gly-Ser-Linker-vL-Myc-CD8TM-BBz-2A-Vif |
| 11269 | | pCDNA3-Vif |

TABLE 10

| Exemplary Bispecific Antibodies targeting different antigens | | | | | | | |
|---|---|---|---|---|---|---|---|
| | | Ag × CD3 | | Ag × CD28 | | Ag × 41BB | |
| Antigen (Ag) | Antigen Binding Domain | SEQ ID NO (DNA) | SEQ ID NO (PRT) | SEQ ID NO (DNA) | SEQ ID NO (PRT) | SEQ ID NO (DNA) | SEQ ID NO (PRT) |
| CD19 | FMC63 | 11620 | 11790 | 11676 | 11846 | 11732 | 11902 |
| CD19 | huFMC63-11 | 11621 | 11791 | 11677 | 11847 | 11733 | 11903 |
| CD19 | huFMC63-11-N203Q | 11622 | 11792 | 11678 | 11848 | 11734 | 11904 |
| CD19 | CD19Bu12 | 11623 | 11793 | 11679 | 11849 | 11735 | 11905 |
| CD19 | CD19MM | 11624 | 11794 | 11680 | 11850 | 11736 | 11906 |
| CD19 | Ritx-CD19-MOR0028 | 11625 | 11795 | 11681 | 11851 | 11737 | 11907 |
| CD19 | CD19-hu-mROO5-1 | 11626 | 11796 | 11682 | 11852 | 11738 | 11908 |
| BCMA | BCMA-J6M0 | 11627 | 11797 | 11683 | 11853 | 11739 | 11909 |
| BCMA | BCMA-huC12A3-L3H3 | 11628 | 11798 | 11684 | 11854 | 11740 | 11910 |
| BCMA | BCMA-huC11.D5.3L1H3 | 11629 | 11799 | 11685 | 11855 | 11741 | 11911 |
| BCMA | BCMA-huC13-F12 | 11630 | 11800 | 11686 | 11856 | 11742 | 11912 |
| CD20 | CD20-2F2 | 11631 | 11801 | 11687 | 11857 | 11743 | 11913 |
| CD20 | CD20-GA101 | 11632 | 11802 | 11688 | 11858 | 11744 | 11914 |
| CD20 | CD20-2H7 | 11633 | 11803 | 11689 | 11859 | 11745 | 11915 |
| CD20 | CD20-Ubli-v4 | 11634 | 11804 | 11690 | 11860 | 11746 | 11916 |
| CD20 | CD20-2H7 | 11635 | 11805 | 11691 | 11861 | 11747 | 11917 |
| CD20 | CD20-7D8 | 11636 | 11806 | 11692 | 11862 | 11748 | 11918 |
| CD22 | CD22-h10F4v2 | 11637 | 11807 | 11693 | 11863 | 11749 | 11919 |
| CD22 | CD22-H22Rhov2A | 11638 | 11808 | 11694 | 11864 | 11750 | 11920 |
| CD22 | CD22-m971-HL | 11639 | 11809 | 11695 | 11865 | 11751 | 11921 |
| CD22 | CD22-5-HL | 11640 | 11810 | 11696 | 11866 | 11752 | 11922 |
| CD22 | CD22-10-HL | 11641 | 11811 | 11697 | 11867 | 11753 | 11923 |
| CD22 | CD22-HA22 | 11642 | 11812 | 11698 | 11868 | 11754 | 11924 |
| CD30 | CD30-5F11 | 11643 | 11813 | 11699 | 11869 | 11755 | 11925 |
| CD30 | CD30-Ac10 | 11644 | 11814 | 11700 | 11870 | 11756 | 11926 |
| CD32 | CD32-Med9 | 11645 | 11815 | 11701 | 11871 | 11757 | 11927 |
| CD33 | CD33-AF5 | 11646 | 11816 | 11702 | 11872 | 11758 | 11928 |

TABLE 10-continued

| Exemplary Bispecific Antibodies targeting different antigens | | | | | | | |
|---|---|---|---|---|---|---|---|
| | | Ag × CD3 | | Ag × CD28 | | Ag × 41BB | |
| Antigen (Ag) | Antigen Binding Domain | SEQ ID NO (DNA) | SEQ ID NO (PRT) | SEQ ID NO (DNA) | SEQ ID NO (PRT) | SEQ ID NO (DNA) | SEQ ID NO (PRT) |
| CD33 | CD33-huMyc9 | 11647 | 11817 | 11703 | 11873 | 11759 | 11929 |
| CD33 | CD33-Him3-4 | 11648 | 11818 | 11704 | 11874 | 11760 | 11930 |
| CD33 | CD33-SGNh2H12 | 11649 | 11819 | 11705 | 11875 | 11761 | 11931 |
| CD33 | CD33-15G15-33 | 11650 | 11820 | 11706 | 11876 | 11762 | 11932 |
| CD33 | CD33-33H4 | 11651 | 11821 | 11707 | 11877 | 11763 | 11933 |
| CD123 | CD123-CSL362 | 11652 | 11822 | 11708 | 11878 | 11764 | 11934 |
| CD123 | CD123-1172 | 11653 | 11823 | 11709 | 11879 | 11765 | 11935 |
| CD123 | CD123-DART-1 | 11654 | 11824 | 11710 | 11880 | 11766 | 11936 |
| CD123 | CD123-DART-2 | 11655 | 11825 | 11711 | 11881 | 11767 | 11937 |
| CD123 | CD123-9D7 | 11656 | 11826 | 11712 | 11882 | 11768 | 11938 |
| CD123 | CD123-3B10 | 11657 | 11827 | 11713 | 11883 | 11769 | 11939 |
| CD138 | CD138 | 11658 | 11828 | 11714 | 11884 | 11770 | 11940 |
| CS1 | CSl-HuLuc64 | 11659 | 11829 | 11715 | 11885 | 11771 | 11941 |
| CS1 | CSl-huLuc90 | 11660 | 11830 | 11716 | 11886 | 11772 | 11942 |
| FLT3 | FLT3-NC7 | 11661 | 11831 | 11717 | 11887 | 11773 | 11943 |
| MPL | MPL-175 | 11662 | 11832 | 11718 | 11888 | 11774 | 11944 |
| MPL | MPL-161 | 11663 | 11833 | 11719 | 11889 | 11775 | 11945 |
| MPL | MPL-111 | 11664 | 11834 | 11720 | 11890 | 11776 | 11946 |
| MPL | Hu-161-2 | 11665 | 11835 | 11721 | 11891 | 11777 | 11947 |
| MPL | MPL-hu-175-2 | 11666 | 11836 | 11722 | 11892 | 11778 | 11948 |
| MPL | MPL-hu-111-2 | 11667 | 11837 | 11723 | 11893 | 11779 | 11949 |
| Lym1 | Lym1 | 11668 | 11838 | 11724 | 11894 | 11780 | 11950 |
| Lym2 | Lym2 | 11669 | 11839 | 11725 | 11895 | 11781 | 11951 |
| CD70 | CD70-h1F6 | 11670 | 11840 | 11726 | 11896 | 11782 | 11952 |
| CD79b | CD79b-2F2 | 11671 | 11841 | 11727 | 11897 | 11783 | 11953 |
| CD179b | CD179b | 11672 | 11842 | 11728 | 11898 | 11784 | 11954 |
| GPRC5D | GPRC5D-ET150-5 | 11673 | 11843 | 11729 | 11899 | 11785 | 11955 |
| GPRC5D | GPRC5D-ET150-18 | 11674 | 11844 | 11730 | 11900 | 11786 | 11956 |

TABLE 11

| CAR "X" TARGET | EXEMPLARY DISEASE TARGETED BY CARs (i.e. conventional CARs and next generation CARs. E.g., SIR, Ab-TCR, TFP and zSIR) |
|---|---|
| CD19 | ALL, CLL, lymphoma, lymphoid blast crisis of CML, multiple myeloma, immune disorders |
| ALK | Non Small Cell Lung Cancer (NSCLC), ALCL (anaplastic large cell lymphoma), IMT (inflammatory myofibroblastic tumor), or neuroblastoma |
| CD45 | Blood cancers |
| BCMA | Myeloma, PEL, plasma cell leukemia, Waldenstrom's macroglobinemia |
| CD5 | Blood cancer, T cell leukemia, T cell lymphoma |
| BAFF-R | Blood cancer, chronic lymphocytic leukemia, B-ALL |
| CD20 | Blood cancers, Leukemia, ALL, CLL, lymphoma, immune disorders |
| CD22 | Blood cancers, Leukemia, ALL, CLL, lymphoma, lymphoid blast crisis of CML, immune disorders |
| CD23 | Blood cancers, Leukemia, ALL, CLL, lymphoma, autoimmune disorders |
| CD30 | Hodgkins's lymphoma, Cutaneous T cell lymphoma |
| CD32 | Solid tumors |
| CD33 | Blood cancers, AML, MDS |
| CD34 | Blood cancers, AML, MDS |
| CD44v6 | Blood cancers, AML, MDS |
| CD70 | Blood cancers, lymphoma, myeloma, waldenstrom's macroglobulinemia |
| CD79b | Blood cancers, ALL, Lymphoma |
| CD123 | Blood cancers, AML, MDS |
| CD138 | Blood cancers, Myeloma, PEL, plasma cell leukemia, waldenstrom's macroglobulinemia |
| CD179b | Blood cancers, ALL, Lymphoma |
| CD276/B7-H3 | Ewing's sarcoma, neuroblastoma, rhabdomyosarcoma, ovarian, colorectal and lung cancers |
| CD324 | Solid tumors, esophageal, prostate, colorectal, breast, lung cancers |
| CDH6 | Solid tumors, renal, ovarian, thyroid cancers |
| CDH17 | Adenocarciniomas, gastrointestinal, lung, ovarian, endometrial cancers |
| CDH19 | Solid tumor, Melanoma |
| EGFR | Colon cancer, lung cancer |
| CLEC5A | Blood cancers, Leukemia, AML |
| GR/LHR | Prostate cancer, ovarian cancer or breast cancer |
| CLL1 | Blood cancer, Leukemia |
| CMVpp65 | CMV infection, CMV colitis, CMV pneumonitis |
| CS1 | Blood cancers, myeloma, PEL, plasma cell leukemia |

TABLE 11-continued

| CAR "X" TARGET | EXEMPLARY DISEASE TARGETED BY CARs (i.e. conventional CARs and next generation CARs. E.g., SIR, Ab-TCR, TFP and zSIR) |
|---|---|
| CSF2RA | AML, CML, MDS |
| CD123 | Blood cancers, AML, MDS |
| DLL3 | Melanoma, lung cancer or ovarian cancer |
| EBNA3c/MHC I | Epstein Barr virus infection and related diseases including cancers |
| EBV-gp350 | Epstein Barr virus infection and related diseases |
| EGFR | Solid tumors, Colon cancer, lung cancer |
| EGFRvIII | Solid tumors, glioblastoma |
| EpCam1 | Gastrointestinal cancer |
| FLT3 | Blood cancers, AML, MDS, ALL |
| Folate Receptor alpha(FR1 or FOLR1) | Ovarian cancer, NSCLC, endometrial cancer, renal cancer, or other solid tumors |
| FSHR | Prostate cancer, ovarian cancer or breast cancer |
| GD2 | Neuroblastoma |
| GD3 | Melanoma |
| GFRa4 | Cancer, thyroid medullary cancer |
| Fucosyl-GM1(GM1) | Small cell lung cancer |
| GPRC5D | Myeloma, PEL, plasma cell leukemia, waldenstrom's macroglobulinemia |
| gp100 | Melanoma |
| GPC3 | Solid tumors, Lung cancer |
| gpNMB | Melanoma, brain tumors, gastric cancers |
| GRP78 | Myeloma |
| Her2 | Solid tumors, breast cancer, stomach cancer |
| Her3 | Colorectal, breast cancer |
| HMW-MAA | Melanoma |
| HTLV1-TAX/MHC I | HTLV1 infection associated diseases, Adult T cell leukemia-lymphoma |
| IL11Ra | Blood cancers, AML, ALL, CML, MDS, sarcomas |
| IL6Ra | Solid tumors, Liver cancer |
| IL13Ra2 | Glioblastomas |
| KSHV-K8.1 | Kaposi's sarcoma, PEL, Multicentric Castleman's disease |
| LAMP1 | Blood cancers, AML, ALL, MDS, CLL, CML |
| LewisY | Cancers |
| L1CAM | Solid tumors, ovarian, breast, endometrial cancers, melanoma |
| LHR | Prostate cancer, ovarian cancer or breast cancer |
| Lym1 | Blood cancer, Leukemia, Lymphoma |
| Lym2 | Blood cancer, Leukemia, Lymphoma |
| CD79b | Blood cancers, lymphoma |
| MART1/MHC I | Melanoma |
| Mesothelin | Mesothelioma, ovarian cancer, pancreatic cancer |
| Muc1/MHC I | Breast cancer, gastric cancer, colorectal cancer, lung cancer, or other solid tumors |
| Muc16 | Ovarian cancer |
| NKG2D | Leukemia, lymphoma or myeloma |
| NYBR1 | Breast cancer |
| PSCA | Prostate cancer |
| PR1/MHC I | Blood cancer, Leukemia |
| Prolactin Receptor | Breast cancer, chromophobe renal cell cancer |
| PSMA | Prostate cancer |
| PTK7 | Melanoma, lung cancer or ovarian cancer |
| ROR1 | Blood cancer, B cell malignancy, lymphoma, CLL |
| SLea | Pancreatic cancer, colon cancer |
| SSEA4 | Pancreatic cancer |
| Tyrosinase/MHC I | Melanoma |
| TCRB1 | T cell leukemias and lymphomas, autoimmune disorders |
| TCRB2 | T cell leukemias and lymphomas, autoimmune disorders |
| TCRgd | T cell leukemias and lymphomas, autoimmune disorders |
| hTERT | Solid tumors, blood cancers |
| TGFBR2 | Solid tumors, keloid |
| TIM1/HAVCR1 | Kidney cancer, liver cancer |
| TROP2 | Solid tumors, Breast cancer, prostate cancer |
| TSHR | Thyroid cancer, T cell leukemia, T cell Lymphoma |
| TSLPR | Blood cancers, Leukemias, AML, MDS |
| Tyrosinase/MHC I | Melanoma |
| VEGFR3 | Solid tumors |
| WT1/MHC I | Blood cancers, AML |
| Folate Receptorβ | AML, Myeloma |
| B7H4 | Breast cancer or ovarian cancer |
| CD23 | Blood cancers, Leukemias, CLL |
| GCC | Gastrointestinal cancer |
| CD200R | Blood cancers, AML, MDS |
| AFP/MHC I | Solid tumors, Liver cancer |

TABLE 11-continued

| CAR "X" TARGET | EXEMPLARY DISEASE TARGETED BY CARs (i.e. conventional CARs and next generation CARs. E.g., SIR, Ab-TCR, TFP and zSIR) |
|---|---|
| CD99 | Liver cancer |
| GPRC5D | Myeloma, waldenstrom's macroglobinemia |
| HPV16-E7/MHC I | HPVI6 associated cancers, cervical cancer, head and neck cancers |
| Tissue Factor 1 (TF1) | Solid tumors |
| Tn-Muc1 | Solid tumors and blood cancers |
| Igk-Light Chain | Myeloma, plasma cell leukemia |
| Ras G12V/MHC I | Solid tumors and blood cancers |
| CLD18A2 (Claudin 18.2) | Gastric, pancreatic, esophageal, ovarian, or lung cancer |
| CD43 | Blood cancers, AML |
| NY-ESO-1/MHC I | Myeloma |
| MPL/TPO-R | Blood cancer, AML, MDS, CML, ALL |
| P-glycoprotein (MDR1) | Renal cancer, liver cancer, Myeloma |
| CD179a | Blood cancers, Acute Leukemia, CLL, ALL, Lymphoma |
| STEAP1 | Gastric or prostate cancer, or lymphoma |
| Liv1 (SLC39A6) | Breast or prostate cancer |
| Nectin4 (PVRL4) | Bladder, renal, cervical, lung, head and neck or breast cancer |
| Cripto (TDGF1) | Colorectal or endometrial or ovarian cancer |
| gpA33 | Colorectal or endometrial or ovarian cancer |
| FLT3 | Blood cancers, AML, ALL, MDS |
| BST1/CD157 | Blood cancers, AML, MDS |
| IL1RAP | Liver, colorectal, cervical, lung or ovarian cancer |
| Chloride channel | Glioma |
| IgE | Allergy |
| HLA-A2 | Graft vs host disease, tissue rejection (SIR Expressed in regulatory T cells) |
| Amyloid | Amyloidoses, alzheimer's disease |
| HIV1-env | HIVI/AIDS and related conditions |
| HIVl-gag | HIV1/AIDS and related conditions |
| Influenza A HA | Influenza A infection |
| Integrin B7 | Plasma cell neoplasms, primary effusion lymphoma |
| Muc17 | Pancreatic cancer, colon cancer |
| CD16ORF54 | Blood cancers |
| VISTA | Blood cancers |
| Muc5Ac | Pancreatic cancer, stomach cancer, colon cancer |
| FCRH5 | Plasma cell neoplasm |
| LYPD1 | Ovarian cancer, endometrial cancer, melanoma |
| EMR2 | Acute Leukemia, Lymphoma, breast cancer, colon cancer |
| gpNMB | Melanoma, brain cancer, breast cancer, solid tumors |
| RNF43 | Colorectal cancer, breast cancer, endometrial cancer |
| CD44v6 | Epithelial cancers |
| Robo4 | Renal, colon, breast cancer, solid tumors |
| GPC3 | Liver cancer, lung cancer, breast cancer |
| FOLR1 | Ovarian cancer, lung cancer, kidney cancer, solid tumors |
| CLDN6 | Ovarian cancer, liver cancer |
| MMP16 | Melanoma, brain cancer, small lung cancer, neuroblastoma |
| BMPR1B | Prostat cancer, breast cancer, ovarian cancer |
| Ly6E | Breast, ovarian, pancreatic, lung |
| WISP1 | Glioblastoma, breast cancer |
| SLC34A2 | Lung cancer, ovarian cancer, endometrial cancer |
| CD133 | Lung cancer, brain cancer |

TABLE 12

| | | Ag × CD3 | | Ag × CD28 | | Ag × 41BB | |
|---|---|---|---|---|---|---|---|
| Antigen (Ag) | Antigen Binding Domain | SEQ ID NO (DNA) | SEQ ID NO (PRT) | SEQ ID NO (DNA) | SEQ ID NO (PRT) | SEQ ID NO (DNA) | SEQ ID NO (PRT) |
| CD19 | FMC63 | 11620 | 11790 | 11676 | 11846 | 11732 | 11902 |
| CD19 | huFMC63-11 | 11621 | 11791 | 11677 | 11847 | 11733 | 11903 |
| CD19 | huFMC63-11-N203Q | 11622 | 11792 | 11678 | 11848 | 11734 | 11904 |
| CD19 | CD19Bu12 | 11623 | 11793 | 11679 | 11849 | 11735 | 11905 |
| CD19 | CD19MM | 11624 | 11794 | 11680 | 11850 | 11736 | 11906 |
| CD19 | Ritx-CD19-MOR0028 | 11625 | 11795 | 11681 | 11851 | 11737 | 11907 |
| CD19 | CD19-hu-mROO5-1 | 11626 | 11796 | 11682 | 11852 | 11738 | 11908 |
| BCMA | BCMA-J6M0 | 11627 | 11797 | 11683 | 11853 | 11739 | 11909 |
| BCMA | BCMA-huC12A3-L3H3 | 11628 | 11798 | 11684 | 11854 | 11740 | 11910 |
| BCMA | BCMA-huC11.D5.3L1H3 | 11629 | 11799 | 11685 | 11855 | 11741 | 11911 |
| BCMA | BCMA-huC13-F12 | 11630 | 11800 | 11686 | 11856 | 11742 | 11912 |
| CD20 | CD20-2F2 | 11631 | 11801 | 11687 | 11857 | 11743 | 11913 |
| CD20 | CD20-GA101 | 11632 | 11802 | 11688 | 11858 | 11744 | 11914 |

TABLE 12-continued

| Antigen (Ag) | Antigen Binding Domain | Ag × CD3 SEQ ID NO (DNA) | Ag × CD3 SEQ ID NO (PRT) | Ag × CD28 SEQ ID NO (DNA) | Ag × CD28 SEQ ID NO (PRT) | Ag × 41BB SEQ ID NO (DNA) | Ag × 41BB SEQ ID NO (PRT) |
|---|---|---|---|---|---|---|---|
| CD20 | CD20-2H7 | 11633 | 11803 | 11689 | 11859 | 11745 | 11915 |
| CD20 | CD20-Ubli-v4 | 11634 | 11804 | 11690 | 11860 | 11746 | 11916 |
| CD20 | CD20-2H7 | 11635 | 11805 | 11691 | 11861 | 11747 | 11917 |
| CD20 | CD20-7D8 | 11636 | 11806 | 11692 | 11862 | 11748 | 11918 |
| CD22 | CD22-h10F4v2 | 11637 | 11807 | 11693 | 11863 | 11749 | 11919 |
| CD22 | CD22-H22Rhov2A | 11638 | 11808 | 11694 | 11864 | 11750 | 11920 |
| CD22 | CD22-m971-HL | 11639 | 11809 | 11695 | 11865 | 11751 | 11921 |
| CD22 | CD22-5-HL | 11640 | 11810 | 11696 | 11866 | 11752 | 11922 |
| CD22 | CD22-10-HL | 11641 | 11811 | 11697 | 11867 | 11753 | 11923 |
| CD22 | CD22-HA22 | 11642 | 11812 | 11698 | 11868 | 11754 | 11924 |
| CD30 | CD30-5F11 | 11643 | 11813 | 11699 | 11869 | 11755 | 11925 |
| CD30 | CD30-Ac10 | 11644 | 11814 | 11700 | 11870 | 11756 | 11926 |
| CD32 | CD32-Med9 | 11645 | 11815 | 11701 | 11871 | 11757 | 11927 |
| CD33 | CD33-AF5 | 11646 | 11816 | 11702 | 11872 | 11758 | 11928 |
| CD33 | CD33-huMyc9 | 11647 | 11817 | 11703 | 11873 | 11759 | 11929 |
| CD33 | CD33-Him3-4 | 11648 | 11818 | 11704 | 11874 | 11760 | 11930 |
| CD33 | CD33-SGNh2H12 | 11649 | 11819 | 11705 | 11875 | 11761 | 11931 |
| CD33 | CD33-15G15-33 | 11650 | 11820 | 11706 | 11876 | 11762 | 11932 |
| CD33 | CD33-33H4 | 11651 | 11821 | 11707 | 11877 | 11763 | 11933 |
| CD123 | CD123-CSL362 | 11652 | 11822 | 11708 | 11878 | 11764 | 11934 |
| CD123 | CD123-1172 | 11653 | 11823 | 11709 | 11879 | 11765 | 11935 |
| CD123 | CD123-DART-1 | 11654 | 11824 | 11710 | 11880 | 11766 | 11936 |
| CD123 | CD123-DART-2 | 11655 | 11825 | 11711 | 11881 | 11767 | 11937 |
| CD123 | CD123-9D7 | 11656 | 11826 | 11712 | 11882 | 11768 | 11938 |
| CD123 | CD123-3B10 | 11657 | 11827 | 11713 | 11883 | 11769 | 11939 |
| CD138 | CD138 | 11658 | 11828 | 11714 | 11884 | 11770 | 11940 |
| CS1 | CS1-HuLuc64 | 11659 | 11829 | 11715 | 11885 | 11771 | 11941 |
| CS1 | CS1-huLuc90 | 11660 | 11830 | 11716 | 11886 | 11772 | 11942 |
| FLT3 | FLT3-NC7 | 11661 | 11831 | 11717 | 11887 | 11773 | 11943 |
| MPL | MPL-175 | 11662 | 11832 | 11718 | 11888 | 11774 | 11944 |
| MPL | MPL-161 | 11663 | 11833 | 11719 | 11889 | 11775 | 11945 |
| MPL | MPL-111 | 11664 | 11834 | 11720 | 11890 | 11776 | 11946 |
| MPL | Hu-161-2 | 11665 | 11835 | 11721 | 11891 | 11777 | 11947 |
| MPL | MPL-hu-175-2 | 11666 | 11836 | 11722 | 11892 | 11778 | 11948 |
| MPL | MPL-hu-111-2 | 11667 | 11837 | 11723 | 11893 | 11779 | 11949 |
| Lyml | Lym1 | 11668 | 11838 | 11724 | 11894 | 11780 | 11950 |
| Lym2 | Lym2 | 11669 | 11839 | 11725 | 11895 | 11781 | 11951 |
| CD70 | CD70-h1F6 | 11670 | 11840 | 11726 | 11896 | 11782 | 11952 |
| CD79b | CD79b-2F2 | 11671 | 11841 | 11727 | 11897 | 11783 | 11953 |
| CD 179b | CD179b | 11672 | 11842 | 11728 | 11898 | 11784 | 11954 |
| GPRC5D | GPRC5D-ET150-5 | 11673 | 11843 | 11729 | 11899 | 11785 | 11955 |
| GPRC5D | GPRC5D-ET150-18 | 11674 | 11844 | 11730 | 11900 | 11786 | 11956 |

TABLE 13

TCR chains useful in various embodiments:

| SEQ ID NO (PRT) | TCR CHAIN |
|---|---|
| 4038 | hTCR-alpha-constant_X02883.1 |
| 4039 | hTCRa-WT |
| 4040 | hTCRa-CSDVP |
| 4041 | hTCRa-opt2 |
| 4042 | hTCRa-T48C-opt |
| 4043 | hTCRa-T48C-opt1 |
| 4044 | hTCRa-SDVP |
| 4045 | hTCRa-S61R |
| 4046 | hTCRa-SDVPR |
| 4047 | hTCRaECD-CD3zECDTMCP-opt2 |
| 4048 | hTCR-b1-constant-region_X00437.1 |
| 4049 | hTCR-b2-constant |
| 4050 | hTCRb-WT |
| 4051 | hTCRb-S57C-opt1 |
| 4052 | hTCRb-KACIAH |
| 4053 | hTCRb-opt2 |
| 4054 | hTCRb-KAIAH |
| 4055 | hTCRb-R79G |
| 4056 | hTCRbECD-CD3zECDTMCP-opt |
| 4057 | preTCRa_gb_U38996.1 |
| 4058 | preTCRa |

TABLE 13-continued

TCR chains useful in various embodiments:

| SEQ ID NO (PRT) | TCR CHAIN |
|---|---|
| 4059 | preTCRa-del48 |
| 4060 | hTCR-gamma_M27331.1 |
| 4061 | hTCR-Gamma-Opt |
| 4062 | hTCR-Delta |
| 4063 | hTCR-Delta-Opt |
| 12602 | TCRa transmembrane domain |
| 12603 | TCRb transmembrane domain |
| 12604 | TCRd transmembrane domain |
| 12605 | TCRg transmembrane domain |
| 12606 | TCRa connecting peptide |
| 12607 | TCRb connecting peptide |
| 12608 | TCRd connecting peptide |
| 12609 | TCRy connecting peptide |
| 12610 | TCRa connecting peptide MD |
| 12611 | TCRb connecting peptide MD |
| 12612 | TCRd connecting peptide MD |
| 12613 | TCRy connecting peptide MD |
| 12614 | TCRb intracellular domain |
| 12615 | TCRy intracellular domain |
| 12616 | TCRD alpha |
| 12617 | TCRD beta |

TABLE 13-continued

TCR chains useful in various embodiments:

| SEQ ID NO (PRT) | TCR CHAIN |
|---|---|
| 12618 | TCRD alpha MD |
| 12619 | TCRD beta MD |
| 12620 | TCRD delta |
| 12621 | TCRD gamma |
| 12622 | TCRD delta MD |
| 12623 | TCRD gamma MD |
| 12624 | CD3e-ECDTMCP |
| 12625 | CD3e-ECD |
| 12626 | CD3e-TM |
| 12627 | CD3e-CP |
| 12628 | CD3d-ECDTMCP |
| 12629 | CD3d-ECD |
| 12630 | CD3d-TM |
| 12631 | CD3d-CP |
| 12632 | CD3g-ECDTMCP |
| 12633 | CD3g-ECD |
| 12634 | CD3g-TM |
| 12635 | CD3g-CP |
| 12636 | CD3zECDTMCP |
| 12637 | CD3z-TM |
| 12638 | CD3z-CP |

In some embodiments, the compositions comprise nucleic acids encoding CARs 1-15 (Table 1), wherein the antigen specific domain of the CAR targets one or more specific antigens as described in Tables 3 or Tables 5-6 in PCT/US2017/064379, which are incorporated herein by reference. In some embodiments, the compositions comprise nucleic acids encoding any one or more of backbones 1-60 (Table 2) where the antigen specific domain of the encoded CAR targets one or more specific antigens as described herein and in Table 3 or Tables 5-6 in PCT/US2017/064379. In some embodiments, the compositions comprise nucleic acids encoding backbone-1, wherein the antigen specific domain of the CAR in backbone-1 targets one or more cancer specific antigens as described herein and in Table 3 or Tables 5-6 in PCT/US2017/064379. In some embodiments, the compositions comprise nucleic acids encoding backbone-8, wherein the antigen specific domain of the CAR in backbone-1 targets one or more cancer specific antigens as described herein and in Table 3 or Tables 5-6 in PCT/US2017/064379.

In various embodiments, the isolated nucleic acid molecules encoding the CAR components of the backbones described herein, encode one, two, three or more antigen specific domains (ASD).

In various embodiments, the isolated nucleic acid molecules encoding the CAR components of the backbones described herein, encodes zero, one, two, three or more co-stimulatory domains.

In various embodiments, the isolated nucleic acid molecules encoding the CAR components of the backbones described herein, encode zero, one, two, three or more intracellular signaling domain.

In various embodiments, the isolated nucleic acid molecules encoding the CAR and the backbones described herein, encode zero, one, two, three or more accessory modules.

The nucleic acid sequences encoding for the desired components of the CARs and accessory modules described herein can be obtained using recombinant methods known in the art. Alternatively, the nucleic acid of interest can be produced synthetically, rather than cloned.

In some embodiments, the genetically modified cells described herein that express the CARs and accessory components described herein also express agents that reduce toxicity of CARs.

In some embodiments, the genetically modified cells described herein that express the CARs and accessory components described herein also express agents that enhance the activity of CARs.

In some embodiments, the genetically modified cells described herein that express the CARs and accessory components described herein also express agents that enhance the persistence of CARs.

In some embodiments, the genetically modified cells described herein that express the CARs and accessory components described herein also express agents that prevent the exhaustion of CARs.

The compositions comprising various backbones as described herein comprise CARs which comprise one or more ASD that binds specifically to a cancer associated antigen as described herein. The sequences of the ASD are contiguous with and in the same reading frame as a nucleic acid sequence encoding the remainder of the one or more chains of CAR.

The polynucleotides, polypeptides, expression constructs, recombinantly engineered cells expressing CARs comprising the antigen binding domains of the disclosure, as well as method of making and using such polypeptides, polynucleotides and cells are described in methods known in the art and methods described in PCT/US2017/024843, WO 2014/160030 A2, WO 2016/187349 A1, PCT/US2016/058305, WO 2015/117229 A1 and PCT/US17/64379, which are incorporated herein by reference in their entirety.

The disclosure provides several antigen binding domains that can be used in the generation of CARs (e.g., CAR 1-15 and backbones 1-60) for applications in adoptive cellular therapy. In some embodiments, these antigen binding domains are derived from antibodies and target antigens that are expressed in cancer, non-cancer proliferative disorders (e.g., endometrioses) and/or immune disorders. The target antigens, SEQ IDs (DNA) and SEQ IDs (PRT) of vL, vH and scFv fragments of these antigen binding domains are shown in Table 3. The CDRs of the vL and vH fragments of the antigen binding domains targeting different antigens are shown in Table 4.

In some embodiments, the encoded antigen binding domain(s) of the CARs polypeptide targeting a specific antigen comprise any one or more of light chain variable domain (vL or VL) amino acid sequences of SEQ ID NO 4118 to 4190, 9631 to 9660 and 11460 to 11462, 14386 to 14415 targeting that antigen as listed in Table 3 wherein up to 9 amino acid residues but no more than 10 amino acids are replaced by any other amino acid residues, or sequences with 80-100% identity to amino acid sequences as set forth in any one of SEQ ID NO 4118 to 4190, 9631 to 9660, or 11460 to 11462 and 14386 to 14415, or sequences with 85-100% identity to the complementarity determining regions (CDR's) of any one of SEQ ID NO SEQ ID NO 4118 to 4190, 9631 to 9660, or 11460 to 11462 and 14386 to 14415. The CDR1, CDR2 and CDR3 of vL fragments with the SEQ ID NO: 4118 to 4190, 9631 to 9660, or 11460 to 11462 are represented by SEQ ID NOs: 11961 to 12066, 12068 to 12173, 12175 to 12280, respectively (Table 4).

In some embodiments, the encoded one or more antigen binding domains of the CARs (conventional CARs and next generation CARs, e.g, SIRs, zSIRs, Ab-TCRs, Tri-Tac and TFP) polypeptide comprise any one or more of heavy chain variable domain (vH or VH) amino acid sequences of SEQ ID NO 4192 to 4264, 9662 to 9691, 11464 to 11466 and 14417 to 14446 targeting that antigen as listed in Table 3 wherein up to 9 amino acid residues but no more than 10 amino acids are replaced by any other amino acid residues or sequences with 80-100% identity to amino acid sequences of SEQ ID NO 4192 to 4264, 9662 to 9691, 11464 to 11466, and 14417 to 14446 or sequences with 85-100% identity to the complementarity determining regions (CDR's) of any one of SEQ ID NO 4192 to 4264, 9662 to 9691, 11464 to 11466, and 14417 to 14446. The CDR1, CDR2 and CDR3 of vH fragments with the SEQ ID NO: 4192 to 4264, 9662 to 9691, 11464 to 11466, and 14417 to 14446 are represented by SEQ ID NOs: 12282 to 12387, 12389 to 12494, 12497 to 12602, 16219-16310 respectively (Table 4).

In some embodiments, the encoded one or more antigen binding domains of the CARs 1-15 and backbones 1-60 polypeptide comprise any one or more of single chain variable fragments (scFv) amino acid sequences of SEQ ID NO 4266 to 4338, 9693 to 9722, 11468 to 11470, and 14448-14477 wherein up to 9 amino acid residues but no more than 10 amino acids are replaced by any other amino acid residues or sequences with 80-100% identity to amino acid sequences of SEQ ID NO 4266 to 4338, 9693 to 9722, 11468 to 11470, and 14448-14477 or sequences with 85-100% identity to the complementarity determining regions (CDR's) of SEQ ID NO 4266 to 4338, 9693 to 9722, 11468 to 11470 and 14448-14477. The CDR1, CDR2 and CDR3 of the vL regions of the scFv fragments with the SEQ ID NO: 4266 to 4338, 9693 to 9722, 11468 to 11470, and 14448-14477 are represented by SEQ ID NOs: 11961 to 12066, 12068 to 12173, 12175 to 12280, 16126-16217 respectively (Table 4). The CDR1, CDR2 and CDR3 of the vH regions of the scFv fragments with the SEQ ID NO: 4266 to 4338, 9693 to 9722, 11468 to 11470, and 14448-14477 are represented by SEQ ID NOs: 12282 to 12387, 12389 to 12494 and 12497 to 12602 and 16219-16310 respectively (Table 4).

It is to be understood that the order of vL and vH fragments in a scFv fragment can be either vL-vH or vH-vL. Thus, even though the exemplarity scFv fragments shown in Table 3 represent either vL-vH or vH-vL orientation, the scFv fragments with the complementary orientation (i.e., vH-vL and vL-vH) can be also used in the methods or compositions of the disclosure.

The DNA and PRT SEQ IDs of exemplary elements that can be used in the construction of different CARs 1-15 and backbones 1-60 are listed in Table 5. The nucleic acid and amino acid SEQ IDs of exemplary conventional CARs (e.g., 2nd generation CARs containing 41BB costimulatory domains), and next generation CARs (e.g., SIRs, zSIRs, Ab-TCRs and TFP) based on the vL and vH fragments derived from BCMA-AM06-HL scFv are provided in Tables 6. The nucleic acid and amino acid SEQ IDs of exemplary conventional CARs (e.g., $2^{nd}$ generation CARs containing 41BB costimulatory domains), and next generation CARs (e.g., SIRs, zSIRs, Ab-TCRs and TFP) based on the vL and vH fragments derived from other scFv fragments can be derived by replacing the vL and vH fragments of BCMA-AM06-HL scFv with the vL and vH fragments of scFv fragments listed in Table 3. The sequence of exemplary CAR constructs containing different antigen binding domains are referenced in Table 7. The order of the different CAR constructs in Table 7 is as shown in Table 6 for BCMA-Am06-HL based CARs. Thus, the CAR construct represented by SEQ ID NO: 475 resembles the CAR construct represented by SEQ ID NO: 377 with the exception that the vL and vH fragments corresponding to the antigen binding domain BCMA-Am06-HL are replaced with the vL and vH fragments corresponding to the antigen binding domain BCMA-Am14-HL. Similarly, the CAR construct represented by SEQ ID NO: 476 resembles the CAR construct represented by SEQ ID NO: 378 with the exception that the vL and vH fragments corresponding to the antigen binding domain BCMA-Am06-HL are replaced with the vL and vH fragments corresponding to the antigen binding domain BCMA-Am14-HL.

In various embodiments, the antigen binding domains of the disclosure show superior in vitro and in vivo properties, such as binding affinity to the target antigens, cytokine secretion, proliferation, cyototoxicity, exhaustion, and long term persistence, when used in the construction of CARs (i.e. conventional CARs and next generation CARs). In various embodiments, these antigen binding domains show diverse in vitro and in vivo properties, such as binding affinity to the target antigens, cytokine secretion, proliferation, cyototoxicity, exhaustion, and long term persistence, when used in the construction of CARs (i.e. conventional CARs and next generation CARs). In various embodiments, the CARs containing these target antigens can be used to generate a diverse immune response.

The disclosure further contemplates CARs that target the same antigen but with different antigen binding domains and may possess diverse biological properties depending in part on the epitope of the antigen targeted by them. Thus, the two groups of Her2 targeting CARs represented by SEQ ID NOs: 2435-2483 and SEQ ID NOs: 2386-2434, see rows 12-13 of Table 7, show different biological properties, such as T cell activation, cytokine secretion and cytotoxicity.

In some embodiments, the antigen specific domain of the encoded CAR molecule comprises an antibody, an antibody fragment, an scFv, a Fv, a Fab, a $(Fab')_2$, a single domain antibody (SDAB), a VH or VL domain, or a camelid VHH domain. In some embodiments, the antigen binding domain of the CAR is a scFv antibody fragment that is humanized compared to the murine sequence of the scFv from which it is derived.

In some instances, scFvs can be prepared according to methods known in the art (for example, Bird et al., (1988) Science 242:423-426 and Huston et al., (1988) Proc. Natl. Acad. Sci. USA 85:5879-5883). ScFv molecules can be produced by linking $V_H$ and $V_L$ regions together using flexible polypeptide linkers. The scFv molecules comprise a linker (e.g., a Ser-Gly linker) with an optimized length and/or amino acid composition. The linker length can greatly affect how the variable regions of a scFv fold and interact. For example, if a short polypeptide linker is employed (for example, between 5-10 amino acids) intrachain folding is prevented. Interchain folding is may be useful to bring the two variable regions together to form a functional epitope binding site. For examples of linker orientation and size see, e.g., Hollinger et al. 1993 Proc Natl Acad. Sci. U.S.A. 90:6444-6448, U.S. Patent Application Publication Nos. 2005/0100543, 2005/0175606, 2007/0014794, and PCT publication Nos. WO2006/020258 and WO2007/024715, the disclosure of which are incorporated herein by reference.

An scFv can comprise a linker of at least 1, 2, 3, 4, 5, 6, 7, 8, 9, 10, 11, 12, 13, 14, 15, 16, 17, 18, 19, 20, 25, 30, 35, 40, 45, 50, or more amino acid residues between its VL and $V_H$ regions. The linker sequence may comprise any naturally occurring amino acid. In some embodiments, the linker sequence comprises amino acids glycine and serine. In another embodiment, the linker sequence comprises sets of glycine and serine repeats such as (Gly4Ser)n, where n is a positive integer equal to or greater than 1. In one embodiment, the linker can be $(Gly4Ser)_3$ or $(Gly4Ser)_3$ or Whitlow linker. Variation in the linker length may retain or enhance activity, giving rise to superior efficacy in activity studies.

In one embodiment, the antigen specific domain of a CAR targeting a specific antigen comprises one, two or all three vH (heavy chain) CDRs (i.e., vH-CDR1, vH-CDR2 and vH-CDR3) of an antigen binding domain listed herein (Table 4), and/or one, two or all three vL (light chain) CDRs (i.e., vL-CDR1, vL-CDR2 and vL-CDR3) of an antigen binding domain listed herein (Table 4).

In another embodiment, the antigen specific domain comprises a humanized antibody or an antibody fragment.

In some embodiments, the antigen specific domain of a CAR described herein is a scFv antibody fragment. In other embodiments, the antibody fragment has a lower binding affinity to the antigen compared to the antibody from which it is derived but is functional in that it provides a biological response described herein. In one embodiment, the CAR molecule comprises an antibody fragment that has a binding affinity KD of $10^{-4}$ M to $10^{-8}$ M, $10^{-5}$ M to $10^{-7}$ M, $10^{-6}$ M or $10^{-8}$ M, for the target antigen.

In some embodiments, antigen specific domain of a CAR described herein binds to a MHC presented peptide. TCR-like antibodies targeting peptides derived from viral or tumor antigens in the context of human leukocyte antigen (HLA)-A1 or HLA-A2 have been described. For example, TCR-like antibody can be identified from screening a library, such as a human scFv phage displayed library.

In some embodiments, when the CARs comprising functional fragments of antibodies (including scFv fragments), as described herein, bind the target antigen, a biological response is induced such as activation of an immune response, cytokine production, cyotoxicity, and the like, as will be understood by a skilled artisan.

In some embodiments, the antigens specific for disease that may be targeted by conventional CARs (e.g., second generation CARs), next generation CARs, (e.g., zSIR, SIR, Ab-TCR, Tri-TAC, TFP etc.) and rTCR when expressed alone or with the accessory modules, as described herein, include, but are not limited to, any one or more of CD5, CD19; CD123; CD22; CD30; CD171; CS-1 (also referred to as CD2 subset 1, CRACC, SLAMF7, CD319, and 19A24); BAFF-R, C-type lectin-like molecule-1 (CLL-1 or CLECL1); CD33; MPL; epidermal growth factor receptor variant III (EGFRviii); ganglioside G2 (GD2); ganglioside GD3 (aNeu5Ac(2-8)aNeu5Ac(2-3)bDGalp(1-4)bDGlcp(1-1)Cer); TNF receptor family member B cell maturation (BCMA); Tn antigen ((Tn Ag) or (GalNAcα-Ser/Thr)); prostate-specific membrane antigen (PSMA); Receptor tyrosine kinase-like orphan receptor 1 (ROR1); FmsLike Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EP-CAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CA1X); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDClalp(1-4)bDGlcp(1-1)Cer); transglutaminase 5 (TGSS); high molecular weight-melanomaassociated antigen (HMWMAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ES0-1); Cancer/testis antigen 2 (LAGE-1a); Melanomaassociated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCT A-1 or Galectin 8), melanoma antigen recognized by T cells 1 (MelanA or MARTI); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin Bl; v-myc avian myelocytomatosis viral oncogene neuroblastoma derived homolog (MYCN); Ras Homolog Family Member C (RhoC); Tyrosinase-related protein 2 (TRP-2); Cytochrome P4501B 1 (CYP1B 1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAXS); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation End products (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIRD; Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen) Fucosyl-GM1, PTK7, gpNMB, CDH1-CD324, DLL3, CD276/B7H3, IL11Ra, IL13Ra2, CD179b-IGL11, ALK TCR-gamma-delta, NKG2D, CD32 (FCGR2A), CSPG4-HMW-MAA, Tim1-/HVCR1, CSF2RA (GM-CSFR-alpha), TGFbetaR2, VEGFR2/KDR, Lews Ag, TCR-beta1 chain, TCR-beta2 chain, TCR-gamma chain, TCR-delta chain, FITC, Leutenizing hormone receptor (LHR), Follicle stimulating hormone receptor (FSHR), Chorionic Gonadotropin Hormone receptor (CGHR), CCR4, SLAMF6, SLAMF4, HIV1 envelope glycoprotein, HTLV1-Tax, CMV pp65, EBV-EBNA3c, influenza A hemagglutinin (HA), GAD, PDL1, Guanylyl cyclase C (GCC), KSHV-K8.1 protein, KSHV-gH protein, auto-antibody to desmoglein 3 (Dsg3), autoantibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IGE, CD99, RAS G12V, Tissue Factor 1 (TF1), AFP, GPRCSD, claudin18.2 (CLD18A2 OR CLDN18A.2), P-glycoprotein, STEAP1, LIV1, NECTIN-4, CRIPTO, MPL, GPA33, BST1/CD157, low conductance chloride channel, Integrin B7, Muc17, C16ORF54, VISTA, Muc5Ac, FCRHS, CLDN6, MMP16, UPK1B, BMPR1B, Ly6E, WISP1 and SLC34A2.

In some embodiments, the antigens associated with or specific for a disease that may be targeted by the CARs, when expressed alone or with the accessory modules as described herein, include, but are not limited to, any one or more of 4-1BB, 5T4, adenocarcinoma antigen, alpha-fetoprotein, BAFF, B-lymphoma cell, C242 antigen, CA-125, carbonic anhydrase 9 (CA-IX), C-MET, CCR4, CD152, CD19, CD20, CD200, CD22, CD221, CD23 (IgE receptor), CD28, CD30 (TNFRSF8), CD33, CD4, CD40, CD44 v6, CD51, CD52, CD56, CD74, CD80, CD123, CEA, CNTO888, CTLA-4, DRS, EGFR, EpCAM, CD3, FAP, fibronectin extra domain-B, folate receptor 1, GD2, GD3 ganglioside, glycoprotein 75, GPNMB, HER2/neu, HGF, human scatter factor receptor kinase, IGF-1 receptor, IGF-I, IgG1, L1-CAM, IL-13, IL-6, insulin-like growth factor I receptor, integrin $\alpha5\beta1$, integrin $\alpha v\beta3$, LAMP1, MORAb-009, MS4A1, MUC1, mucin CanAg, N-glycolylneuraminic acid, NPC-1C, PDGF-R $\alpha$, PDL192, phosphatidylserine, prostatic carcinoma cells, RANKL, RON, ROR1, SCH 900105, SDC1, SLAMF7, TAG-72, tenascin C, TGF beta 2, TGF-$\beta$, TRAIL-R1, TRAIL-R2, tumor antigen CTAA16.88, VEGF-A, VEGFR-1, VEGFR2, vimentin and combinations thereof. Other antigens specific for cancer will be apparent to those of skill in the art and may be used in connection with alternate embodiments of the disclosure.

In some embodiments, the antigens associated with or specific for cancer that may be targeted by the CARs, when expressed alone or with the accessory modules as described herein, include, but are not limited to, any one or more of BCMA, FLT3, CD19, CD20 (MS4A1), CD22, STEAP1, CD79b, Integrin B7, Her2, Her3, Liv1, TSHR (Thyroid Stimulating Hormone Receptor), PSMA, MSLN (Mesothelin), EGFRviii, Nectin 4, Prolactin Receptor (PRLR), Muc17, Muc5Ac, CD70, CD179b, CDH19, CD16ORF54, VISTA (V-set immunoregulatory receptor or VSIR), GPC3 (glypican 3), DLL3 (delta like canonical Notch ligand 3), PTK7, FCRHS (Fc receptor like 5), LYPD1 (LY6/PLAUR domain containing 1), EMR2 (adhesion G protein-coupled receptor E2 or ADGRE2), gpNMB (glycoprotein nmb), ring finger protein 43 (RNF43), Robo4, CEA, Her3, Folate Receptor 1 (FOLR1), CLDN6 (Claudin 6), MMP16 (matrix metallopeptidase 16), uroplakin 1B (UPK1B), bone morphogenetic protein receptor type 1B (BMPR1B), Ly6E, WISP1, SLC34A2, Cripto, gpA33, ROR1, CLL1, IL1RAP, BST1, CD133 and combinations thereof. In some embodiments, the antigen specific domains of the CARs are specific for BCMA, FLT3, CD19, CD20 (MS4A1), CD22, STEAP1, CD79b, Integrin B7, Her2, Her3, Liv1, TSHR (Thyroid Stimulating Hormone Receptor), PSMA, MSLN (Mesothelin), EGFRviii, Nectin 4, Prolactin Receptor (PRLR), Muc17, Muc5Ac, CD70, CD179b, CDH19, CD16ORF54, VISTA (V-set immunoregulatory receptor or VSIR), GPC3 (glypican 3), DLL3 (delta like canonical Notch ligand 3), PTK7, FCRHS (Fc receptor like 5), LYPD1 (LY6/PLAUR domain containing 1), EMR2 (adhesion G protein-coupled receptor E2 or ADGRE2), gpNMB (glycoprotein nmb), ring finger protein 43 (RNF43), Robo4, CEA, Her3, Folate Receptor 1 (FOLR1), CLDN6 (Claudin 6), MMP16 (matrix metallopeptidase 16), uroplakin 1B (UPK1B), bone morphogenetic protein receptor type 1B (BMPR1B), Ly6E, WISP1, SLC34A2, Cripto, gpA33, ROR1, CLL1, IL1RAP, BST1 and CD133. In some embodiments, the antigen specific domains of the CARs comprise scFv sequences whose SEQ IDs are set forth in Table 3. In some embodiments, the antigen specific domains of the CARs comprise CDR sequences whose SEQ IDs are set forth in Table 4.

In various embodiments, the immune cells expressing the CARs, both conventional and next generation CARs (e.g., SIR, zSIR, Ab-TCR, TFP and the like), comprising these antigen binding domains can be generated and used for adoptive cellular therapy of cancer, infectious and immune disorders using methods known in the art and methods described in PCT/US2017/024843, WO 2014/160030 A2, WO 2016/187349 A1, PCT/US2016/058305 and PCT/US17/64379, which are incorporated herein by reference in their entirety.

A CAR (e.g., CAR II, SIR, zSIR, Ab-TCR, Tri-TAC, TFP and the like) when used alone or with accessory modules, as described herein, can comprise an antigen binding domain (e.g., antibody or antibody fragment) that binds to a disease-supporting antigen (e.g., a disease-supporting antigen as described herein). In some embodiments, the disease-supporting antigen is an antigen present on cells that support the survival and proliferation of disease causing cells. In some embodiments, the disease-supporting antigen is an antigen present on a stromal cell or a myeloid-derived suppressor cell (MDSC). Stromal cells can secrete growth factors and cytokines to promote cell proliferation in the microenvironment. MDSC cells can block T cell proliferation and activation. Without wishing to be bound by theory, in some embodiments, the CAR (e.g., CARII, SIR, zSIR, Ab-TCR, TFP and the like) expressing cells destroy the disease-supporting cells, thereby indirectly blocking growth or survival of disease causing cells.

In some embodiments, the stromal cell antigen is selected from one or more of: bone marrow stromal cell antigen 2 (BST2), fibroblast activation protein (FAP) and tenascin. In embodiments, the MDSC antigen is selected from one or more of: CD33, CD11b, C14, CD15, and CD66b. Accordingly, in some embodiments, the disease supporting antigen is selected from one or more of: bone marrow stromal cell antigen 2 (BST2), fibroblast activation protein (FAP) or tenascin, CD33, CD11b, C14, CD15, and CD66b.

In another embodiment, each antigen specific region of the CAR (e.g., CAR II, SIR, zSIR, Ab-TCR, TFP and the like) may comprise a divalent (or bivalent) single-chain variable fragment (di-scFvs, bi-scFvs). In some embodiments, CARs (e.g., CAR II, SIR, zSIR, Ab-TCR, TFP and the like) comprising at least two antigen-specific targeting regions would express two scFvs specific for each of the two antigens. The resulting ASD is joined to the co-stimulatory domain and the intracellular signaling domain via a hinge region and a transmembrane domain. An exemplary CAR (a zSIR) targeting two antigens is represented by SEQ ID NO: 3962 and targets CD19 and CD123.

In an additional embodiment, each ASD of the CAR comprises a diabody.

In some embodiments, the ASD of the CAR (e.g., CAR I, CAR II, SIR, zSIR, Ab-TCR, TFP and the like) comprises $V_L$ fragments whose SEQ IDs and target antigens are listed in Table 3.

In some embodiments, the ASD of the CAR (e.g., CAR I, CAR II, SIR, zSIR, Ab-TCR, TFP and the like) comprises $V_H$ fragments whose SEQ IDs and target antigens are listed in Table 3.

In some embodiments, the ASD of the CAR (e.g., CAR I, CAR II, SIR, zSIR, Ab-TCR, TFP and the like) comprises scFvs whose SEQ IDs and target antigens are listed in Table 3.

In one embodiment, an antigen specific domain of a CAR (e.g., CAR I, CAR II, SIR, zSIR, Ab-TCR, TFP and the like) against a target antigen is an antigen binding portion, e.g., CDRs, of vL and vH fragments targeting this antigen whose SEQ IDs are listed in Table 4.

In one embodiment, an antigen specific domain of a CAR (e.g., CAR I, CAR II, SIR, zSIR, Ab-TCR, TFP and the like) against a target antigen is an antigen binding portion, e.g., CDRs, of the vL and vH fragments of scFvs targeting this antigen whose SEQ IDs are listed in Tables 4.

In some embodiments, the ASD of the CAR (e.g., CAR I, CAR II, SIR, zSIR, Ab-TCR, TFP and the like) comprises $V_{HH}$ fragments (nanobodies).

In one embodiment, an antigen specific domain of a CAR (e.g., CAR I, CAR II, SIR, zSIR, Ab-TCR, TFP and the like) against a target antigen is an antigen binding portion of a non-immunoglobulin scaffold targeting this antigen.

In one embodiment, an antigen specific domain of a CAR (e.g., CAR I, CAR II, SIR, zSIR, Ab-TCR, TFP and the like) against a target antigen is an antigen binding portion of a receptor known to bind this target antigen.

In one embodiment, an antigen binding specific domain of a CAR (e.g., CAR I, CAR II, SIR, zSIR, Ab-TCR, TFP and the like) against a target antigen is an antigen binding portion of a ligand known to bind this target antigen.

The disclosure demonstrates that CARs targeting the same antigen may have different biological properties depending on the particular epitope of the antigen to which they bind. Thus, two CD19-targeted CARs (e.g., SEQ ID NO: 916 and 818) may have different biological properties (e.g., cytotoxicity, proliferation or cytokine secretion etc.) depending on the different CD19-epitopes to which they bind. In an embodiment, the disclosure provides CARs (e.g., CAR I, CAR II, SIR, zSIR, Ab-TCR, TFP and the like) that bind to the same epitope on the different targets listed in Tables 3 as any of the CARs of the disclosure (i.e., CARs (e.g., CAR I, CAR II, SIR, zSIR, Ab-TCR, TFP and the like) that have the ability to cross-compete for binding to the different targets with any of the CARs of the disclosure). In some embodiments, the antigen specific domains of these CARs (e.g., CAR I, CAR II, SIR, zSIR, Ab-TCR, TFP and the like) could be derived from vL fragments, vH fragments or scFv fragments of antibodies. In some embodiments, the reference antibodies for cross-competition studies to determine the target-epitope recognized by a CAR (e.g., CAR I, CAR II, SIR, zSIR, Ab-TCR, TFP and the like) of the disclosure are scFvs targeting that antigen and having sequences as shown in SEQ ID NOs: 4266-4338, 9693-9722 and 11468-11470 (Table 3). In an exemplary embodiment, the reference scFv BCMA-Am14-HL represented by SEQ ID NO: 4266 can be used in cross-competition studies to determine the target-epitope recognized by BCMA-Am14-HL-based CARs and backbones of the disclosure. In some embodiments, the reference CARs for cross-competition studies against different targets are CARs (e.g., CAR I, CAR II, SIR, zSIR, Ab-TCR, TFP and the like) whose SEQ IDs are shown in Table 7.

In an exemplary embodiment, the reference scFvs for cross-competition studies to determine the target-epitopes recognized by the CD19-targeting CARs (e.g., CAR I, CAR II, SIR, zSIR, Ab-TCR, TFP and the like) of the disclosure are scFvs having sequences as shown in SEQ ID NOs: 4269-4270, 4272, 4298, 4299, 4338, 14462 (Table 3).

In an exemplary embodiment, the reference CARs for cross-competition studies to determine the target-epitopes recognized by the CD19-targeting CARs (e.g., CAR I, CAR II, SIR, zSIR, Ab-TCR, TFP and the like) of the disclosure are CARs having sequences as shown in SEQ ID NOs: 4830-4871, 4781-4829, 4872-4920, 4732-4780, 4683-4731, 4970-5018, and 4921-4969 (Table 7).

In an embodiment, the reference scFvs for cross-competition studies to determine the target-epitopes recognized by the CD20-targeting CARs (e.g., CAR I, CAR II, SIR, zSIR, Ab-TCR, TFP and the like) of the disclosure are scFvs targeting CD20 and having SEQ IDs as listed in Table 3.

In an embodiment, the reference CARs for cross-competition studies to determine the target-epitopes recognized by the CD20-targeting CARs (e.g., CAR I, CAR II, SIR, zSIR, Ab-TCR, TFP and the like) of the disclosure are CARs targeting CD20 and having SEQ IDs as listed in Table 7.

In an embodiment, the reference scFvs for cross-competition studies to determine the target-epitopes recognized by the CD22-targeting CARs (e.g., CAR I, CAR II, SIR, zSIR, Ab-TCR, TFP and the like) of the disclosure are scFvs targeting CD22 CD20 and having SEQ IDs 14449-14458, 14460, 14469-70 as listed in Table 3.

In an embodiment, the reference CARs for cross-competition studies to determine the target-epitopes recognized by the CD22-targeting CARs (e.g., CAR I, CAR II, SIR, zSIR, Ab-TCR, TFP and the like) of the disclosure are CARs targeting CD22 and having SEQ IDs as listed in Table 7.

In an embodiment, the reference scFvs for cross-competition studies to determine the target-epitopes recognized by the BAFF-R-targeting CARs (e.g., CAR I, CAR II, SIR, zSIR, Ab-TCR, TFP and the like) of the disclosure are scFvs targeting BAFF-R and having SEQ IDs: 14465-14467 as listed in Table 3.

In an embodiment, the reference CARs for cross-competition studies to determine the target-epitopes recognized by the BAFF-R-targeting CARs (e.g., CAR I, CAR II, SIR, zSIR, Ab-TCR, TFP and the like) of the disclosure are CARs targeting BAFF-R and having SEQ IDs as listed in Table 7.

In an embodiment, the reference scFvs for cross-competition studies against DLL3-targeting CARs (e.g., CAR I, CAR II, SIR, zSIR, Ab-TCR, TFP and the like) of the disclosure are scFvs targeting DLL3 and having SEQ IDs as listed in Table 3.

In an embodiment, the reference CARs for cross-competition studies against DLL3-targeting CARs (e.g., CAR I, CAR II, SIR, zSIR, Ab-TCR, TFP and the like) of the disclosure are CARs targeting DLL3 and having SEQ IDs as listed in Table 7.

In an embodiment, the reference scFvs for cross-competition studies against PTK7-targeting CARs (e.g., CAR I, CAR II, SIR, zSIR, Ab-TCR, TFP and the like) of the disclosure are scFvs targeting PTK7 and having SEQ IDs as listed in Table 3.

In an embodiment, the reference CARs for cross-competition studies against PTK7-targeting CARs (e.g., CAR I, CAR II, SIR, zSIR, Ab-TCR, TFP and the like) of the disclosure are CARs targeting PTK7 and having SEQ IDs as listed in Table 7.

In an embodiment, the reference scFvs for cross-competition studies to determine the target-epitopes recognized by MSLN (Mesothelin)-targeting CARs (e.g., CAR I, CAR II, SIR, zSIR, Ab-TCR, TFP and the like) of the disclosure are scFvs targeting MSLN and having SEQ IDs as listed in Table 3.

In one embodiment, the reference scFvs for cross-competition studies to determine the target-epitopes recognized by the MSLN-targeting CARs (e.g., CAR I, CAR II, SIR, zSIR, Ab-TCR, TFP and the like) of the disclosure are represented by SEQ ID NOs: 4284-4285, 4293-4295, 9715 and 9716.

In another embodiment, the reference CARs for cross-competition studies to determine the target-epitopes recognized by the MSLN-targeting CARs (e.g., CAR I, CAR II, SIR, zSIR, Ab-TCR, TFP and the like) of the disclosure are CARs targeting MSLN and having SEQ IDs as listed in Table 7.

In an embodiment, the reference scFvs for cross-competition studies to determine the target-epitopes recognized by Her2-targeting CARs (e.g., CAR I, CAR II, SIR, zSIR, Ab-TCR, TFP and the like) of the disclosure are scFvs targeting Her2 and having SEQ IDs as listed in Table 3.

In one embodiment, the reference scFvs for cross-competition studies to determine the target-epitopes recognized by the Her2-targeting CARs (e.g., CAR I, CAR II, SIR, zSIR, Ab-TCR, TFP and the like) of the disclosure are represented by SEQ ID NOs: 4276-4279.

In another embodiment, the reference CARs for cross-competition studies to determine the target-epitopes recognized by the Her2-targeting CARs (e.g., CAR I, CAR II, SIR, zSIR, Ab-TCR, TFP and the like) of the disclosure are Her2-CARs with SEQ ID NOs: 6244-6292, 6391-6439, 6342-6390, and 6293-6341 (Table 7).

In an embodiment, the reference scFv for cross-competition studies to determine the target-epitopes recognized by TSHR-targeting CARs (e.g., CAR I, CAR II, SIR, zSIR, Ab-TCR, TFP and the like) of the disclosure is scFv targeting TSHR and having SEQ ID: 4280 as listed in Table 3.

In another embodiment, the reference CARs for cross-competition studies to determine the target-epitopes recognized by the TSHR-targeting CARs (e.g., CAR I, CAR II, SIR, zSIR, Ab-TCR, TFP and the like) of the disclosure are TSHR-CARs with SEQ ID NOs: 7567-7615 (Table 7).

In an embodiment, the reference scFvs for cross-competition studies to determine the target-epitopes recognized by EGFRviii-targeting CARs (e.g., CAR I, CAR II, SIR, zSIR, Ab-TCR, TFP and the like) of the disclosure are scFvs targeting EGFRviii and having SEQ IDs as listed in Table 3.

In another embodiment, the reference CARs for cross-competition studies to determine the target-epitopes recognized by the EGFRviii-targeting CARs (e.g., CAR I, CAR II, SIR, zSIR, Ab-TCR, TFP and the like) of the disclosure are EGFRviii-CARs with SEQ ID NOs: 5607-5655, 5705-5753, 5754-5802 and 5656-5704.

In an embodiment, the reference scFvs for cross-competition studies to determine the target-epitopes recognized by PRLR (Prolactin Receptor)-targeting CARs (e.g., CAR I, CAR II, SIR, zSIR, Ab-TCR, TFP and the like) of the disclosure are scFvs targeting PRLR (Prolactin Receptor) and having SEQ IDs as listed in Table 3. In one embodiment, the reference scFvs for cross-competition studies to determine the target-epitopes recognized by the PRLR-targeting CARs (e.g., CAR I, CAR II, SIR, zSIR, Ab-TCR, TFP and the like) of the disclosure are represented by SEQ ID NOs: 4296 and 4309.

In another embodiment, the reference CARs for cross-competition studies to determine the target-epitopes recognized by the PRLR-targeting CARs (e.g., CAR I, CAR II, SIR, zSIR, Ab-TCR, TFP and the like) of the disclosure are PRLR CARs with SEQ ID Nos: 7077-7125 and 7126-7174 as listed in Table 7.

In another embodiment, the reference scFvs for cross-competition studies to determine the target-epitopes recognized by the PSMA (Prostate Specific Membrane Antigen)-targeting CARs (e.g., CAR I, CAR II, SIR, zSIR, Ab-TCR, TFP and the like) of the disclosure (e.g., SEQ ID NOs: 7273-7321, 7224-7272 and 7175-7223) are the scFvs targeting PSMA listed in Table 3 (e.g., SEQ ID NOs: 4281-4283). In one embodiment, the reference scFvs for cross-competition studies to determine the target-epitopes recognized by the PSMA-targeting CARs (e.g., CAR I, CAR II, SIR, zSIR, Ab-TCR, TFP and the like) of the disclosure are represented by SEQ ID NOs: 4281-4283.

In another embodiment, the reference CARs for cross-competition studies to determine the target-epitopes recognized by the PSMA-targeting CARs (e.g., CAR I, CAR II, SIR, zSIR, Ab-TCR, TFP and the like) of the disclosure are PSMA CARs listed in Table 7 (e.g., SEQ ID NOs: 7273-7321, 7224-7272 and 7175-7223).

In another embodiment, the reference scFvs for cross-competition studies to determine the target-epitopes recognized by the DLL3-targeting CARs (e.g., CAR I, CAR II, SIR, zSIR, Ab-TCR, TFP and the like) of the disclosure are the DLL3-targeting scFvs listed in Table 3 (e.g., SEQ ID NOs: 4290-4291).

In another embodiment, the reference scFvs for cross-competition studies to determine the target-epitopes recognized by the FOLR1-targeting CARs (e.g., CAR I, CAR II, SIR, zSIR, Ab-TCR, TFP and the like) of the disclosure (e.g., SEQ ID NOs: 5999-6047 and 6048-6096) are the FOLR1-targeting scFvs listed in Table 3 (e.g., SEQ ID NOs: 4323-4324). In one embodiment, the reference scFvs for cross-competition studies to determine the target-epitopes recognized by the FOLR1-targeting CARs of the disclosure are represented by SEQ ID NOs: 5999-6047 and 6048-6096).

In another embodiment, the reference scFvs for cross-competition studies to determine the target-epitopes recognized by the GPC3-targeting CARs (e.g., CAR I, CAR II, SIR, zSIR, Ab-TCR, TFP and the like) of the disclosure (e.g., SEQ ID NOs: 6097-6145 and 6146-6194) are the GPC3-targeting scFvs listed in Table 3 (e.g., SEQ ID NOs: 4307-4308). In one embodiment, the reference scFvs for cross-competition studies to determine the target-epitopes recognized by the GPC3-targeting CARs of the disclosure are represented by SEQ ID NOs: 6097-6145 and 6146-6194).

In another embodiment, the reference scFvs for cross-competition studies to determine the target-epitopes recognized by the WISP1-targeting CARs (e.g., CAR I, CAR II, SIR, zSIR, Ab-TCR, TFP and the like) of the disclosure (e.g., SEQ ID NOs: 7812-7860 and 7861-7909) are the WISP1-targeting scFvs listed in Table 3 (e.g., SEQ ID NOs: 4335 and 4336). In one embodiment, the reference scFvs for cross-competition studies to determine the target-epitopes recognized by the WISP1-targeting CARs of the disclosure are represented by SEQ ID NOs:7812-7860 and 7861-7909.

In another embodiment, the reference scFvs for cross-competition studies to determine the target-epitopes recognized by the EMR2-targeting CARs (e.g., CAR I, CAR II, SIR, zSIR, Ab-TCR, TFP and the like) of the disclosure (e.g., SEQ ID NOs: 5803-5851, 5852-5900 and 5901-5949) are the EMR2-targeting scFvs listed in Table 3 (e.g., SEQ ID NOs: 4313, 4314 and 4315). In one embodiment, the reference scFvs for cross-competition studies to determine the target-epitopes recognized by the EMR2-targeting CARs of the disclosure are represented by SEQ ID NOs: 4803-5851, 585-5900, 5901-5949

In another embodiment, the reference scFvs for cross-competition studies to determine the target-epitopes recognized by the UPK1B-targeting CARs (e.g., CAR I, CAR II, SIR, zSIR, Ab-TCR, TFP and the like) of the disclosure (e.g., SEQ ID NOs: 7616-7664, 7665-7713) are the UPK1B-targeting scFvs listed in Table 3 (e.g., SEQ ID NOs: 4328 and 4329). In one embodiment, the reference scFvs for cross-competition studies to determine the target-epitopes recognized by the UPK1B-targeting CARs of the disclosure are represented by SEQ ID NOs: 7616-7664, 7665-7713.

In another embodiment, the reference scFvs for cross-competition studies to determine the target-epitopes recognized by the BMPR1B-targeting CARs (e.g., CAR I, CAR II, SIR, zSIR, Ab-TCR, TFP and the like) of the disclosure (e.g., SEQ ID NOs: 4536-4584, 4585-4633) are the BMPR1B-targeting scFvs listed in Table 3 (e.g., SEQ ID NOs: 4330 and 4331). In one embodiment, the reference scFvs for cross-competition studies to determine the target-epitopes recognized by the BMPR1B-targeting CARs of the disclosure are represented by SEQ ID NOs: 4536-4584, 4585-4633.

In another embodiment, the reference CARs for cross-competition studies to determine the target-epitopes recognized by the BMPR1B-targeting CARs (e.g., CAR I, CAR II, SIR, zSIR, Ab-TCR, TFP and the like) of the disclosure are BMPR1B CARs listed in Table 7 (e.g., SEQ ID NOs: 4536-4584, 4585-4633).

In another embodiment, the reference scFvs for cross-competition studies to determine the target-epitopes recognized by the CDH19-targeting CARs (e.g., CAR I, CAR II, SIR, zSIR, Ab-TCR, TFP and the like) of the disclosure (e.g., SEQ ID NOs: 5264-5312, 5313-5361) are the CDH19-targeting scFvs listed in Table 3 (e.g., SEQ ID NOs: 4302 and 4303). In one embodiment, the reference scFvs for cross-competition studies to determine the target-epitopes recognized by the CDH19-targeting CARs of the disclosure are represented by SEQ ID NOs: 5264-5312, 5313-5361.

In another embodiment, the reference CARs for cross-competition studies to determine the target-epitopes recognized by the CDH19-targeting CARs (e.g., CAR I, CAR II, SIR, zSIR, Ab-TCR, TFP and the like) of the disclosure are the CDH19 CARs listed in Table 7 (e.g., SEQ ID NOs: 5264-5312, 5313-5361).

In another embodiment, the reference scFvs for cross-competition studies to determine the target-epitopes recognized by the VISTA-targeting CARs of the disclosure (e.g., SEQ ID NOs: 7763-7811, 7714-7762) are the VISTA-targeting scFvs listed in Table 3 (e.g., SEQ ID NOs: 4305 and 4306). In one embodiment, the reference scFvs for cross-competition studies to determine the target-epitopes recognized by the VISTA-targeting CARs (e.g., CAR I, CAR II, SIR, zSIR, Ab-TCR, TFP and the like) of the disclosure are represented by SEQ ID NOs: 7763-7811, 7714-7762.

In another embodiment, the reference CARs for cross-competition studies to determine the target-epitopes recognized by the VISTA-targeting CARs (e.g., CAR I, CAR II, SIR, zSIR, Ab-TCR, TFP and the like) of the disclosure are VISTA CARs listed in Table 7 (e.g., SEQ ID NOs: 7763-7811, 7714-7762).

In another embodiment, the reference scFv for cross-competition studies to determine the target-epitopes recognized by the IL13Ra2-targeting CARs (e.g., CAR I, CAR II, SIR, zSIR, Ab-TCR, TFP and the like) of the disclosure are IL13Ra2 scFv listed in Table 3 (e.g., SEQ ID NO: 14448).

In another embodiment, the reference CARs for cross-competition studies to determine the target-epitopes recognized by the IL13Ra2-targeting CARs (e.g., CAR I, CAR II, SIR, zSIR, Ab-TCR, TFP and the like) of the disclosure are IL13Ra2 CARs listed in Table 7 (e.g., SEQ ID NO: 15857-15909).

In another embodiment, the reference scFvs for cross-competition studies to determine the target-epitopes recognized by the FLT3-targeting CARs (e.g., CAR I, CAR II, SIR, zSIR, Ab-TCR, TFP and the like) of the disclosure (e.g., SEQ ID NOs: 10606-10654, 10557-10605) are the FLT3-targeting scFvs listed in Table 3 (e.g., SEQ ID NOs: 9710 and 9711). In one embodiment, the reference scFvs for cross-competition studies to determine the target-epitopes recognized by the FLT3-targeting CARs (e.g., CAR I, CAR II, SIR, zSIR, Ab-TCR, TFP and the like) of the disclosure are represented by SEQ ID NOs: 10557-10605, 10606-10654.

In another embodiment, the reference CARs for cross-competition studies to determine the target-epitopes recognized by the FLT3-targeting CARs (e.g., CAR I, CAR II, SIR, zSIR, Ab-TCR, TFP and the like) of the disclosure are FLT3 CARs listed in Table 7 (e.g., SEQ ID NOs: 10557-10605, 10606-10654).

In another embodiment, the reference scFvs for cross-competition studies to determine the target-epitopes recognized by the CLDN6-targeting CARs (e.g., CAR I, CAR II, SIR, zSIR, Ab-TCR, TFP and the like) of the disclosure (e.g., SEQ ID NOs: 5411-5459, 5460-5508) are the CLDN6-targeting scFvs listed in Table 3 (e.g., SEQ ID NOs: 4325 and 4326). In one embodiment, the reference scFvs for cross-competition studies to determine the target-epitopes recognized by the CLDN6-targeting CARs (e.g., CAR I, CAR II, SIR, zSIR, Ab-TCR, TFP and the like) of the disclosure are represented by SEQ ID NOs: 5411-5459, 5460-5508.

In another embodiment, the reference CARs for cross-competition studies to determine the target-epitopes recognized by the CLDN6-targeting CARs (e.g., CAR I, CAR II, SIR, zSIR, Ab-TCR, TFP and the like) of the disclosure are CLDN6 CARs listed in Table 7 (e.g., SEQ ID NOs: 5411-5459, 5460-5508).

In another embodiment, the reference scFvs for cross-competition studies to determine the target-epitopes recognized by the ROBO4-targeting CARs (e.g., CAR I, CAR II, SIR, zSIR, Ab-TCR, TFP and the like) of the disclosure (e.g., SEQ ID NOs: 7420-7468) are the ROBO4-targeting scFvs listed in Table 3 (e.g., SEQ ID NOs: 4320). In one embodiment, the reference scFvs for cross-competition studies to determine the target-epitopes recognized by the ROBO4-targeting CARs (e.g., CAR I, CAR II, SIR, zSIR, Ab-TCR, TFP and the like) of the disclosure are represented by SEQ ID NOs: 7420-7468.

In another embodiment, the reference CARs for cross-competition studies to determine the target-epitopes recognized by the ROBO4-targeting CARs (e.g., CAR I, CAR II, SIR, zSIR, Ab-TCR, TFP and the like) of the disclosure are ROBO4 CARs listed in Table 7 (e.g., SEQ ID NOs: 7420-7468).

In another embodiment, the reference scFvs for cross-competition studies to determine the target-epitopes recognized by the IL1RAP-targeting CARs (e.g., CAR I, CAR II, SIR, zSIR, Ab-TCR, TFP and the like) of the disclosure (e.g., SEQ ID NOs: 10802-10850, 10851-10899, 10900-10948) are the IL1RAP-targeting scFvs listed in Table 3 (e.g., SEQ ID NOs: 9712, 9713 and 9714). In one embodiment, the reference scFvs for cross-competition studies to determine the target-epitopes recognized by the IL1RAP-targeting CARs (e.g., CAR I, CAR II, SIR, zSIR, Ab-TCR, TFP and the like) of the disclosure are represented by SEQ ID NOs: 10802-10850, 10851-10899, 10900-10948.

In another embodiment, the reference CARs for cross-competition studies to determine the target-epitopes recognized by the IL1RAP-targeting CARs (e.g., CAR I, CAR II, SIR, zSIR, Ab-TCR, TFP and the like) of the disclosure are IL1RAP CARs listed in Table 7 (e.g., SEQ ID NOs: 10802-10850, 10851-10899, 10900-10948).

In another embodiment, the reference scFvs for cross-competition studies to determine the target-epitopes recognized by the CD22-targeting CARs (e.g., CAR I, CAR II, SIR, zSIR, Ab-TCR, TFP and the like) of the disclosure (e.g., SEQ ID NOs: 5068-5115, 10361-10409) are the CD22-targeting scFvs listed in Table 3 (e.g., SEQ ID NOs: 4271, 9693, 12502). In one embodiment, the reference scFvs for cross-competition studies to determine the target-epitopes recognized by the CD22-targeting CARs (e.g., CAR I, CAR II, SIR, zSIR, Ab-TCR, TFP and the like) of the disclosure are represented by SEQ ID NOs: 5068-5115, 10361-10409.

In another embodiment, the reference CARs for cross-competition studies to determine the target-epitopes recognized by the CD22-targeting CARs (e.g., CAR I, CAR II, SIR, zSIR, Ab-TCR, TFP and the like) of the disclosure are CD22 CARs listed in Table 7 (e.g., SEQ ID NOs: 5068-5115, 10361-10409).

In another embodiment, the reference scFvs for cross-competition studies to determine the target-epitopes recognized by the CLL1-targeting CARs (e.g., CAR I, CAR II, SIR, zSIR, Ab-TCR, TFP and the like) of the disclosure (e.g., SEQ ID NOs: 10459-10507, 10410-10458) are the CLL1-targeting scFvs listed in Table 3 (e.g., SEQ ID NOs: 9708 and 9703). In one embodiment, the reference scFvs for cross-competition studies to determine the target-epitopes recognized by the CLL1-targeting CARs (e.g., CAR I, CAR II, SIR, zSIR, Ab-TCR, TFP and the like) of the disclosure are represented by SEQ ID NOs: 10410-10458, 10459-10507.

In another embodiment, the reference CARs for cross-competition studies to determine the target-epitopes recognized by the CLL1-targeting CARs (e.g., CAR I, CAR II, SIR, zSIR, Ab-TCR, TFP and the like) of the disclosure are CLL1 CARs listed in Table 7 (e.g., SEQ ID NOs: 10410-10458, 10459-10507).

In another embodiment, the reference scFvs for cross-competition studies to determine the target-epitopes recognized by the BST1-targeting CARs (e.g., CAR I, CAR II, SIR, zSIR, Ab-TCR, TFP and the like) of the disclosure (e.g., SEQ ID NOs: 10116-10164, 10165-10212, 10213-10262) are the BST1-targeting scFvs listed in Table 3 (e.g., SEQ ID NOs: 9718, 9719, and 9720). In one embodiment, the reference scFvs for cross-competition studies to determine the target-epitopes recognized by the BST1-targeting CARs (e.g., CAR I, CAR II, SIR, zSIR, Ab-TCR, TFP and the like) of the disclosure are represented by SEQ ID NOs: 10116-10164, 10165-10212, 10213-10262.

In another embodiment, the reference CARs for cross-competition studies to determine the target-epitopes recognized by the BST1-targeting CARs (e.g., CAR I, CAR II, SIR, zSIR, Ab-TCR, TFP and the like) of the disclosure are BST1 CARs listed in Table 7 (e.g., SEQ ID NOs: 10116-10164, 10165-10212, 10213-10262).

In another embodiment, the reference scFvs for cross-competition studies to determine the target-epitopes recognized by the NECTIN-4-targeting CARs (e.g., CAR I, CAR II, SIR, zSIR, Ab-TCR, TFP and the like) of the disclosure (e.g., SEQ ID NOs: 7028-7076, 11096-11242) are the NECTIN-4-targeting scFvs listed in Table 3 (e.g., SEQ ID NOs: 4292, 9696). In one embodiment, the reference scFvs for cross-competition studies to determine the target-epitopes recognized by the NECTIN-4-targeting CARs (e.g., CAR I, CAR II, SIR, zSIR, Ab-TCR, TFP and the like) of the disclosure are represented by SEQ ID NOs: 7028-7076, 11096-11242.

In another embodiment, the reference CARs for cross-competition studies to determine the target-epitopes recognized by the NECTIN-4-targeting CARs (e.g., CAR I, CAR II, SIR, zSIR, Ab-TCR, TFP and the like) of the disclosure are NECTIN-4 CARs listed in Table 7 (e.g., SEQ ID NOs: 7028-7076, 11096-11242).

In another embodiment, the reference scFvs for cross-competition studies to determine the target-epitopes recognized by the GPA33-targeting CARs (e.g., CAR I, CAR II, SIR, zSIR, Ab-TCR, TFP and the like) of the disclosure (e.g., SEQ ID NOs: 10655-10703) are the GPA33-targeting scFvs listed in Table 3 (e.g., SEQ ID NOs: 9698). In one embodiment, the reference scFvs for cross-competition studies to determine the target-epitopes recognized by the GPA33-targeting CARs (e.g., CAR I, CAR II, SIR, zSIR, Ab-TCR, TFP and the like) of the disclosure are represented by SEQ ID NOs: 10655-10703.

In another embodiment, the reference CARs for cross-competition studies to determine the target-epitopes recognized by the GPA33-targeting CARs (e.g., CAR I, CAR II, SIR, zSIR, Ab-TCR, TFP and the like) of the disclosure are GPA33 CARs listed in Table 7 (e.g., SEQ ID NOs: 10655-10703).

In another embodiment, the reference scFvs for cross-competition studies to determine the target-epitopes recognized by the ROR1-targeting CARs (e.g., CAR I, CAR II, SIR, zSIR, Ab-TCR, TFP and the like) of the disclosure (e.g., SEQ ID NOs: 11145-11193) are the ROR1-targeting scFvs listed in Table 3 (e.g., SEQ ID NOs: 9699). In one embodiment, the reference scFvs for cross-competition studies to determine the target-epitopes recognized by the ROR1-targeting CARs (e.g., CAR I, CAR II, SIR, zSIR, Ab-TCR, TFP and the like) of the disclosure are represented by SEQ ID NOs: 11145-11193.

In another embodiment, the reference CARs for cross-competition studies to determine the target-epitopes recognized by the ROR1-targeting CARs (e.g., CAR I, CAR II, SIR, zSIR, Ab-TCR, TFP and the like) of the disclosure are ROR1 CARs listed in Table 7 (e.g., SEQ ID NOs: 11145-11193).

In another embodiment, the reference scFvs for cross-competition studies to determine the target-epitopes recognized by the CRIPTO-targeting CARs (e.g., CAR I, CAR II, SIR, zSIR, Ab-TCR, TFP and the like) of the disclosure (e.g., SEQ ID NOs: 10508-10556) are the CRIPTO-targeting scFvs listed in Table 3 (e.g., SEQ ID NOs: 9697). In one embodiment, the reference scFvs for cross-competition studies to determine the target-epitopes recognized by the CRIPTO-targeting CARs (e.g., CAR I, CAR II, SIR, zSIR, Ab-TCR, TFP and the like) of the disclosure are represented by SEQ ID NOs: 10508-10556.

In another embodiment, the reference CARs for cross-competition studies to determine the target-epitopes recognized by the CRIPTO-targeting CARs (e.g., CAR I, CAR II, SIR, zSIR, Ab-TCR, TFP and the like) of the disclosure are CRIPTO CARs listed in Table 7 (e.g., SEQ ID NOs: 10508-10556).

In some embodiments, two or more functional domains of the CARs (e.g., CAR I, CAR II, SIR, zSIR, Ab-TCR, TFP and the like) as described herein, are separated by one or more linkers. Linkers are oligo- or polypeptides region from about 1 to 100 amino acids in length, that link together any of the domains/regions of the CAR (e.g., CAR I, CAR II, SIR, zSIR, Ab-TCR, TFP and the like) of the disclosure. In some embodiments, the linkers may be for example, 5-12 amino acids in length, 5-15 amino acids in length or 5-20 amino acids in length (or any integer there between). Linkers may be composed of flexible residues like glycine and serine so that the adjacent protein domains are free to move relative to one another. Longer linkers, for example those longer than 100 amino acids, may be used in connection with alternate embodiments of the disclosure, and may be selected to, for example, ensure that two adjacent domains do not sterically interfere with one another. The SEQ ID Nos of several exemplary linkers are listed in Table 5 (see, e.g., SEQ ID Nos: 4007 to 4012).

In some embodiments, the CARs (which form part of the backbones) described herein comprise a hinge region between the antigen specific domain and the transmembrane domain. In some embodiments, the hinge region comprises any one or more of human CD8a or an Fc fragment of an antibody or a functional equivalent, fragment or derivative thereof, a hinge region of human CD8a or an antibody or a functional equivalent, fragment or derivative thereof, a CH2 region of an antibody, a CH3 region of an antibody, an artificial spacer sequence and combinations thereof. In exemplary embodiments, the hinge region comprises any one or more of (i) a hinge, CH2 and CH3 region of IgG4, (ii) a hinge region of IgG4, (iii) a hinge and CH2 region of IgG4, (iv) a hinge region of CD8a, (v) a hinge, CH2 and CH3 region of IgG1, (vi) a hinge region of IgG1, (vi) a hinge and CH2 region of IgG1, or (vii) combinations thereof.

As described herein, the CARs (e.g., CAR I, CAR II, SIR, zSIR, Ab-TCR, TFP and the like) (which form part of the backbones) described herein comprise a transmembrane domain. The transmembrane domain may comprise the transmembrane sequence from any protein which has a transmembrane domain, including any of the type I, type II or type III transmembrane proteins. The transmembrane domain of the CAR (e.g., CAR I, CAR II, SIR, zSIR, Ab-TCR, TFP and the like) of the disclosure may also comprise an artificial hydrophobic sequence. The transmembrane domains of the CARs (e.g., CAR I, CAR II, SIR, zSIR, Ab-TCR, TFP and the like) described herein may be selected so that the transmembrane domain do not dimerize. In some embodiments, the TMD encoded CAR (e.g., CAR I, CAR II, SIR, zSIR, Ab-TCR, TFP and the like) comprising any of the backbones described herein comprises a transmembrane domain selected from the transmembrane domain of an alpha, beta or zeta chain of a T-cell receptor, CD3ε, CD3, CD3γ, CD3δ, CD28, CD45, CD4, CD5, CD8, CD9, CD16, CD22, CD33, CD37, CD64, CD80, CD86, CD134, CD137, CD154, KIRDS2, OX40, CD2, CD27, LFA-1 (CD11a, CD18), ICOS (CD278), 4-1BB (CD137), GITR, CD40, BAFFR, HVEM (LIGHTR), SLAMF7, NKp80 (KLRF1), CD160, CD19, IL2R beta, IL2R gamma, IL7R a, ITGA1, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, DNAM1 (CD226), SLAMF4 (CD244, 2B4), CD84, CD96 (Tactile), CEACAM1, CRT AM, Ly9 (CD229), CD160 (BY55), PSGL1, CDIOO (SEMA4D), SLAMF6 (NTB-A, Ly108), SLAM (SLAMF1, CD150, IPO-3), BLAME (SLAMF8), SELPLG (CD162), LTBR, PAG/Cbp, NKp44, NKp30, NKp46, NKG2D, and/or NKG2C.

A transmembrane domain can include one or more additional amino acids adjacent to the transmembrane region, e.g., one or more amino acid associated with the extracellular region of the protein from which the transmembrane was derived (e.g., 1, 2, 3, 4, 5, 6, 7, 8, 9, 10 up to 15 amino acids of the extracellular region) and/or one or more additional amino acids associated with the intracellular region of the protein from which the transmembrane protein is derived (e.g., 1, 2, 3, 4, 5, 6, 7, 8, 9, 10 up to 15 amino acids of the intracellular region). In one aspect, the transmembrane domain is contiguous with one of the other domains of the CAR (e.g., CAR I, CAR II, SIR, zSIR, Ab-TCR, TFP and the like). In one embodiment, the transmembrane domain may be from the same protein that the signaling domain, costimulatory domain or the hinge domain is derived from. In another aspect, the transmembrane domain is not derived from the same protein that any other domain of the CAR (e.g., CAR I, CAR II, SIR, zSIR, Ab-TCR, TFP and the like) is derived from.

As described herein, the CARs (e.g., CAR I, CAR II, SIR, zSIR, Ab-TCR, TFP and the like) (which form part of the backbones) described herein comprise an intracellular signaling domain. This domain may be cytoplasmic and may transduce the effector function signal and direct the cell to perform its specialized function. Examples of intracellular signaling domains include, but are not limited to, ζ chain of the T-cell receptor or any of its homologs (e.g., η chain, FceRlv and β chains, MB1 (Iga) chain, B29 (IgP) chain, etc.), CD3 polypeptides (Δ, δ and ε), syk family tyrosine kinases (Syk, ZAP 70, etc.), src family tyrosine kinases (Lck, Fyn, Lyn, etc.) and other molecules involved in T-cell transduction, such as CD2, CD5 and CD28. The intracellular signaling domain may be human CD3 zeta chain, FcγRIII, FcsRI, cytoplasmic tails of Fc receptors, immunoreceptor tyrosine-based activation motif (ITAM) bearing cytoplasmic receptors or combinations thereof. Additional intracellular signaling domains will be apparent to those of skill in the art and may be used in connection with alternate embodiments of the disclosure. In some embodiments, the intracellular signaling domain comprises a signaling domain of one or more of a human CD3 zeta chain, FcgRIII, FceRI, a cytoplasmic tail of a Fc receptor, an immunoreceptor tyrosine-based activation motif (ITAM) bearing cytoplasmic receptors, and combinations thereof.

As described herein, the CARs (e.g., CAR I, CAR II, SIR, zSIR, Ab-TCR, TFP and the like) (which form part of the backbones) described herein comprise a co-stimulatory domain. In exemplary embodiments, the co-stimulatory domain comprises a signaling domain from any one or more of CD28, CD137 (4-1BB), CD134 (OX40), Dap10, CD27, CD2, CD5, ICAM-1, LFA-1, Lck, TNFR-I, TNFR-II, Fas, CD30, CD40 and combinations thereof.

Cleavable linkers as described herein include 2A linkers (for example T2A), 2A-like linkers or functional equivalents thereof and combinations thereof. In some embodiments, the linkers include the picornaviral 2A-like linker, CHYSEL sequences of porcine teschovirus (P2A), *Thosea asigna* virus (T2A) or combinations, variants and functional equivalents thereof. In other embodiments, the linker sequences may comprise Asp-Val/Ile-Glu-X-Asn-Pro-Gly$^{(2A)}$-Pro$^{(2B)}$ motif, which results in cleavage between the 2A glycine and the 2B proline. The nucleic sequences of several exemplary cleavable linkers are provided in SEQ ID NO: 80 to SEQ ID NO: 85 and amino acid sequences of several exemplary linkers are provided in SEQ ID NO: 4079 to SEQ ID NO: 4084. Other linkers will be apparent to those of skill in the art and may be used in connection with alternate embodiments of the disclosure. In an embodiment, a Ser-Gly-Ser-Gly (SGSG) motif (SEQ ID NOs: 931-932 and SEQ ID NO: 4844-4845) is also added upstream of the cleavable linker sequences to enhance the efficiency of cleavage. A potential drawback of the cleavable linkers is the possibility that the small 2A tag left at the end of the N-terminal protein may affect protein function or contribute to the antigenicity of the proteins. To overcome this limitation, in some embodiments, a furine cleavage site (RAKR) (SEQ ID NO: 88-90 and 4087-4089) is added upstream of the SGSG motifs to facilitate cleavage of the residual 2A peptide following translation. In an embodiment, cleavable linkers are placed between the polypeptide encoding the CAR and the polypeptide encoding the accessory modules. The cleavage at the site of cleavable linker results in separation of the two polypeptides.

"Accessory modules" as used herein refer to agents that enhance, reduce or modify the activity of T cells expressing the CARs (e.g., CAR I, CAR II, SIR, zSIR, Ab-TCR, TFP and the like) or reduce toxicity associated with CARs (e.g., CAR I, CAR II, SIR, zSIR, Ab-TCR, TFP and the like) so that the therapeutic response of the CARs is enhanced. An accessory module may also enhance the gene transfer into and/or expression of CAR encoding cassette in the target cells, e.g., an immune effector cell.

In some embodiments, vectors comprising polynucleotides encoding CARs (e.g., CAR I, CAR II, SIR, zSIR, Ab-TCR, TFP and the like) can further comprise polynucleotides encoding viral and cellular signaling proteins which (i) extend the life span of T cells expressing the CARs (e.g., CAR I, CAR II, SIR, zSIR, Ab-TCR, TFP and the like), (ii) stimulate T cell proliferation and/or (iii) protect T cells expressing the CARs (e.g., CAR I, CAR II, SIR, zSIR, Ab-TCR, TFP and the like) from apoptosis; (iv) enhance packaging, gene transfer and/or expression of CAR (e.g., CAR I, CAR II, SIR, zSIR, Ab-TCR, TFP and the like) constructs. In exemplary embodiments, such proteins include but are not limited to vFLIP-K13 (SEQ ID NO (DNA): 108; SEQ ID NO (PRT): 4107) from Kaposi's sarcoma associated herpes virus and HIV-1 Vif (SEQ ID NO: 118 and 4117).

In one embodiment, vectors encoding CARs (e.g., CAR I, CAR II, SIR, zSIR, Ab-TCR, TFP and the like) further encode vFLIP-K13. In one embodiment, vFLIP-K13 nucleotide sequence is codon optimized. An exemplary CAR (i.e., SIR) co-expressing codon optimized vFLIP K13 is represented by SEQ ID NO: 14057. In one embodiment, vectors encoding CARs further encode HIV-1 Vif. In an alternate embodiment, vectors encoding CARs further encode both vFLIP K13 and HIV-1 Vif.

In some embodiments, the accessory molecules are encoded by vectors that are distinct from the vectors encoding by the CARs (e.g., CAR I, CAR II, SIR, zSIR, Ab-TCR, TFP and the like) described herein. In some embodiments, effector cells comprising vectors encoding CARs (e.g., CAR I, CAR II, SIR, zSIR, Ab-TCR, TFP and the like) also comprise vectors encoding accessory molecules. In some embodiments, the accessory molecules are encoded by modifying the genomic locus encoding the corresponding endogenous protein.

In some embodiments, vectors comprising polynucleotides encoding CARs (e.g., CAR I, CAR II, SIR, zSIR, Ab-TCR, TFP and the like) further comprise polynucleotides encoding siRNA or scFv specific for cytokines. In exemplary embodiments, the cytokines are any one or more of IL-10, IL-6, IFN or combinations thereof. In some embodiment, the CARs (e.g., CAR I, CAR II, SIR, zSIR, Ab-TCR, TFP and the like) are co-expressed with a secreted bispecific antibody fragment that binds to IL6 receptor $\alpha$ and human serum albumin. In some embodiment, the CARs (e.g., CAR I, CAR II, SIR, zSIR, Ab-TCR, TFP and the like) are co-expressed with a secreted scFv fragment that binds to IL6. In some embodiments, the CARs (e.g., CAR I, CAR II, SIR, zSIR, Ab-TCR, TFP and the like) are coexpressed with the peptide FX06 so as to mitigate capillary leak associated with CAR therapy.

In further embodiments, vectors comprising polynucleotides encoding CARs (e.g., CAR I, CAR II, SIR, zSIR, Ab-TCR, TFP and the like) further comprise polynucleotides encoding siRNA or a nuclease targeting the endogenous TCR-$\alpha$, TCR-$\beta$, TCR-$\gamma$, TCR-delta, CD3gamma, CD3zeta, CD3epsilon, CD3-delta. In further embodiments, polynucleotides encoding siRNA or a nuclease targeting the endogenous TCR-$\alpha$, TCR-$\beta$, TCR-$\gamma$, TCR-delta, CD3gamma, CD3zeta, CD3epsilon, CD3-delta are encoded by vectors others than the vectors encoding CARs (e.g., CAR I, CAR II, SIR, zSIR, Ab-TCR, TFP and the like).

In further embodiments, vectors comprising polynucleotides encoding CARs (e.g., CAR I, CAR II, SIR, zSIR, Ab-TCR, TFP and the like) further comprise polynucleotides encoding a selectable marker. In exemplary embodiment, the selectable marker can encode a drug resistance gene, such as gene that confers resistance to puromycin or calcineurin inhibitors (e.g. CNB30). In some embodiment, the selectable marker may encode for extracellular and transmembrane domains of human CD30, CD20, CD19 (SEQ ID NO: 96 and 4095), BCMA (SEQ ID NO: 97 and 4096), EGFR (SEQ ID NO: 95 and 4094), CD34, or any protein or protein fragment that is expressed on cell surface and can be recognized by an antibody that can be used to eliminate cells expressing its target antigen. In an exemplary embodiment, cetuximab, an anti-EGFR monoclonal is used to eliminate CAR-expressing cells of the disclosure which coexpress a truncated EGFR. The selectable marker(s) can be used to enrich for cells expressing the CAR (e.g., CAR I, CAR II, SIR, zSIR, Ab-TCR, TFP and the like), to select for cells that express high levels of CAR (e.g., CAR I, CAR II, SIR, zSIR, Ab-TCR, TFP and the like) and/or to reduce the clonal diversity of the cells expressing the CAR (e.g., CAR I, CAR II, SIR, zSIR, Ab-TCR, TFP and the like). In further embodiments, polynucleotides encoding CARs (e.g., CAR I, CAR II, SIR, zSIR, Ab-TCR, TFP and the like) may encode for epitope tags (e.g., Myc tag) that are expressed on the extracellular domain of the CARs (e.g., CAR I, CAR II, SIR, zSIR, Ab-TCR, TFP and the like) and can be used to enrich for cells expressing the CAR (e.g., CAR I, CAR II, SIR, zSIR, Ab-TCR, TFP and the like), to select for cells that express high levels of CAR (e.g., CAR I, CAR II, SIR, zSIR, Ab-TCR, TFP and the like) and/or to reduce the clonal diversity of the cells expressing the CAR (e.g., CAR I, CAR II, SIR, zSIR, Ab-TCR, TFP and the like). Reducing the clonal diversity of allogeneic T cells expressing the CARs (e.g., CAR I, CAR II, SIR, zSIR, Ab-TCR, TFP and the like) will in turn lead to reduced incidence of Graft versus Host Disease (GVHD), thereby allowing the use of allogeneic T cells for CAR-T cell therapy.

It is to be noted that the accessory modules are optional for the activity of a CAR (e.g., CAR I, CAR II, SIR, zSIR, Ab-TCR, TFP and the like). The polypeptide and polynucleotides of a number of exemplary CAR (e.g., CAR I, CAR II, SIR, zSIR, Ab-TCR, TFP and the like) constructs (i.e., backbones) in Table 6 and Table 7 contain accessory modules such as PAC, K13, and/or hNEMO-K277A-Flag. In alternate embodiments of the disclosure, these CAR (e.g., CAR I, CAR II, SIR, zSIR, Ab-TCR, TFP and the like) constructs can be used without the presence of the accessory modules and the intervening cleavable liner (e.g., P2A or F2A or T2A).

In certain embodiments, the disclosure provides a novel platform of synthetic immune receptors, designated zSIRs, containing two CD3z chains. The nucleic acid sequences of the CD3z chains that can be used in the construction of zSIR are provided in SEQ ID NO: 67 and 71. The corresponding amino acid sequences are provided in SEQ ID NO: 4066 and 4070, respectively. The disclosure provides that the vL fragment of an antibody can be joined to one of the two CD3z chains and the vH fragment can be joined to the other CD3z chain. When the two such chains (e.g. vL-CD3z and vH-CD3z) are co-expressed in the same cell, the vL and vH fragments can bind their cognate antigen and transmit a T cell signal. In particular, T cells expressing such zSIR when exposed to a cell line expressing the cognate target antigen can activate NFAT signaling, induce IL2 production, promote T cell proliferation, promote T cell activation and exert cytotoxicity. The expression and activity of the zSIR can be further increased by incorporation of a linker between the vL/vH and the CD3z fragments. In particular, the IgCL (SEQ ID NO (DNA): 28 and SEQ ID NO (PRT): 4027) and IgCH domains (SEQ ID NO (DNA): 29 and SEQ ID NO (PRT): 4028) derived from antibodies serve as useful linkers between the vL/vH and CD3z fragments.

In another embodiment, a costimulatory domain is also incorporated in the CD3z chain(s) of zSIR. Exemplary costimulatory domains include costimulatory domains of 41BB and CD28. CD3z chains containing 41BB and CD28 costimulatory domains are presented in SEQ ID NO: 4076, 4078 and 4075, 4077, respectively (Table 5). Collectively, the above results provide a novel platform for adoptive cellular therapy that overcomes some of the design limitations of SIR and also provide a complementary approach to SIRs The two chains of zSIRs described herein may be encoded by a single polynucleotide chain and translated into a single polypeptide chain, which is subsequently cleaved into different proteins. The two chains of zSIRs described herein may be expressed using two distinct promoters and encoded by two separate polynucleotide chains. The two chains of zSIRs described herein may be encoded by a single vector. The two chains of zSIRs described herein may be encoded by a two different vector. The nucleic acid molecule encoding a zSIR can comprise one or more leader sequences (also known as a signal peptide). In one embodiment, each functional unit (e.g., an antigen binding domain joined to a CD3z chain plus Furine-SGSG-cleavable linker) of a zSIR can be preceded by a leader sequence which directs the zSIR to the cell surface as a type I transmembrane protein. In one embodiment, the antigen-binding domain of zSIR is extracellular-facing. In some embodiments, the leader sequence comprises the nucleic acid sequence of any of SEQ ID NO: 1 to 4 and amino acid sequences of SEQ ID NO: 4000 to SEQ ID NO: 4003. In some embodiments, short nucleic acid sequences (3-9 nucleic acids) comprising restriction enzyme sites are located between the different subunits of a zSIR, e.g., between a signal sequence and the antigen binding domain of the zSIR or between the antigen binding and the CD3z chain.

Provided herein are one or more polypeptides encoded by one or more nucleic acid molecules encoding CARs (e.g., CAR I, CAR II, SIR, zSIR, Ab-TCR, TFP and the like) 1 to 15 (Table 1) or any one or more of backbones 1-60 described herein (Table 2).

In some embodiments, the antigen-specific domain of the CARs (e.g., CAR I, CAR II, SIR, zSIR, Ab-TCR, TFP and the like) is specific to one, two, three or more antigens on target cells, such as cancer cells. As described herein, in some embodiments, each component of the CAR (e.g., CAR I, CAR II, SIR, zSIR, Ab-TCR, TFP and the like) is contiguous and in the same reading frame with each other components of the CAR (e.g., CAR I, CAR II, SIR, zSIR, Ab-TCR, TFP and the like). In some embodiments, if the CAR (e.g., CAR I, CAR II, SIR, zSIR, Ab-TCR, TFP and the like) comprising backbone comprises more than one antigen specific domain, each of the antigen specific domains are contiguous and in the same reading frame as the other antigen specific domains in the same CAR (e.g., CAR I, CAR II, SIR, zSIR, Ab-TCR, TFP and the like).

Also provided herein are one or more polypeptides encoded by one or more nucleic acid molecules encoding backbone-1 comprising CAR I and K13-vFLIP as described herein. In some embodiments, the antigen-specific domain of the CAR comprising backbone-1 is specific to one, two, three or more antigens on target cells, such as cancer cells. As described herein, in some embodiments, each component of the CAR is contiguous and in the same reading frame with each other components of the CAR comprising backbone-1. In some embodiments, the CAR comprising backbone-1 comprises more than one antigen specific domain, each of the antigen specific domains are contiguous and in the same reading frame as the other antigen specific domains in the same CAR.

Also provided herein are one or more polypeptides encoded by one or more nucleic acid molecules encoding backbone-8 which comprises CAR II (CAR 2) and HIV-1 Vif as described herein. In some embodiments, the antigen-specific domain of the CAR comprising backbone-8 is specific to one, two, three or more antigens on target cells, such as cancer cells. As described herein, each component of the CAR is contiguous and in the same reading frame with each other components of the CAR. In some embodiments, in the CAR comprising backbone-8 comprises more than one antigen specific domain, each of the antigen specific domains are contiguous and in the same reading frame as the other antigen specific domains in the same CAR.

In various embodiments, the polypeptides encoded by the nucleic acid molecules encoding CARs (e.g., CAR I, CAR II, SIR, zSIR, Ab-TCR, TFP and the like) which are part of CARs 1 to 15 (see, Table 1) or part of the backbones described herein, such as backbone-1, backbone-2, backbone-32 or backbone-60, comprise two, three or more antigen specific domains.

In various embodiments, the polypeptides encoded by the nucleic acid molecules encoding CARs (e.g., CAR I, CAR II, SIR, zSIR, Ab-TCR, TFP and the like) which are part of CARs 1 to 15 (see, Table 1) or part of the backbones described herein, such as backbone-1, backbone-2, backbone-32 or backbone-60, comprise two, three or more co-stimulatory domains.

In various embodiments, the polypeptides encoded by the nucleic acid molecules encoding CARs (e.g., CAR I, CAR II, SIR, zSIR, Ab-TCR, TFP and the like) which are part of CARs 1 to 15 (see, Table 1) or part of the backbones described herein, such as backbone-1, backbone-2, backbone-32 or backbone-60, comprise zero, one, two, three or more intracellular signaling domain.

In various embodiments, the polypeptides encoded by the nucleic acid molecules encoding CARs (e.g., CAR I, CAR II, SIR, zSIR, Ab-TCR, TFP and the like) which are part of the backbones described herein, such as backbone-1, backbone-2, backbone-32 or backbone-60, comprise one, two, three or more viral and/or cellular signaling proteins.

The nucleic acid sequences encoding for the desired components of the CARs (e.g., CAR I, CAR II, SIR, zSIR, Ab-TCR, TFP and the like) described herein can be obtained using recombinant methods known in the art, such as, for example by screening libraries from cells expressing the nucleic acid molecule, by deriving the nucleic acid molecule from a vector known to include the same, or by isolating directly from cells and tissues containing the same, using standard techniques. Alternatively, the nucleic acid of interest can be produced synthetically, rather than cloned.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, Table 1) or are part of backbones described herein, such as backbone-1, backbone-2, backbone-32 or backbone-60, wherein the antigen-specific domain of the CARs (e.g., CAR I, CAR II, SIR, zSIR, Ab-TCR, TFP and the like) is specific to target as described in Table 3.

In one embodiment, an antigen specific domain of a CAR (e.g., CAR I, CAR II, SIR, zSIR, Ab-TCR, TFP and the like) against a target antigen is an antigen binding portion, e.g., CDRs, of vL and vH fragments targeting this antigen whose SEQ ID is shown in Tables 3 and 4.

In one embodiment, an antigen specific domain of a CAR (e.g., CAR I, CAR II, SIR, zSIR, Ab-TCR, TFP and the like) against a target antigen is an antigen binding portion, e.g., CDRs, of vHH fragments targeting this antigen.

In one embodiment, an antigen specific domain of a CAR (e.g., CAR I, CAR II, SIR, zSIR, Ab-TCR, TFP and the like) against a target antigen is an antigen binding portion of a non-immunoglobulin scaffold targeting this antigen.

In one embodiment, an antigen specific domain of a CAR (e.g., CAR I, CAR II, SIR, zSIR, Ab-TCR, TFP and the like) against a target antigen is an antigen binding portion of a receptor known to bind this target antigen.

In one embodiment, an antigen binding specific domain of a CAR (e.g., CAR I, CAR II, SIR, zSIR, Ab-TCR, TFP and the like) against a target antigen is an antigen binding portion of a ligand known to bind this target antigen.

In one embodiment, an antigen specific domain of a CAR (e.g., CAR I, CAR II, SIR, zSIR, Ab-TCR, TFP and the like) against a target antigen is an antigen binding portion, e.g., CDRs, of vL and vH fragments of a scFV targeting this antigen whose SEQ ID is shown in Table 3. The SEQ ID NOs of the CDRs are shown in Table 4.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to the targets shown in Table 3.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of the backbones described herein, such as backbone-1, backbone-2, backbone-32 or backbone-60, wherein the antigen-specific domains of the CARs are specific to CD19.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to CD20.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to CD22.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to BCMA.

In some embodiments, provided herein are polypeptides encoded by the nucleic acid molecules encoding CARs (e.g., CAR I, CAR II, SIR, zSIR, Ab-TCR, TFP and the like) which are part of the conventional CARs 1 to 15 (see, e.g., Table 1) or are part of backbones described herein, such as backbone-1, backbone-2, backbone-32 or backbone-60, wherein the antigen-specific domains of the CARs are specific to Integrin B7.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to Her2.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to TSHR.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to PSMA.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to MSLN.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to EGFR viii.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to DLL3.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to Nectin-4.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to Prolactin Receptor (PRLR).

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to Muc17.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to CD70.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to Prolactin Receptor CDH19.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to CD16ORF54.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to VISTA.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to GPC3.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to MucSAc.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to FCRHS.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to LYPD1

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to EMR2.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to gpNMB.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to RNF43.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to CD44v6.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to Robo4.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to CEA.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to Her3.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to FOLR1.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to CLDN6.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to MMP16.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to UPK1B.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to BMPR1B.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to Ly6E.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to CD79b.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to WISP1.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to SLC34A2.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to Liv1.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to Cripto.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to gpA33.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to ROR1.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to CLL1.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to FLT3.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to IL1RAP.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to BST1.

In some embodiments, provided herein are polypeptides encoded by the nucleic acid molecules encoding CARs (e.g., CAR I, CAR II, SIR, zSIR, Ab-TCR, TFP and the like) which are part of the CARs 1 to 15 (see, e.g., Table 1) or are part of backbones described herein, such as backbone-1, backbone-2, backbone-32 or backbone-60, wherein the antigen-specific domains of the CARs are specific to CD133.

In some embodiments, provided herein are polypeptides encoded by the nucleic acid molecules encoding zSIRs which are part of CARs 7-15 (see, e.g., Table 1), wherein the antigen-specific domains are specific to CD200R.

In some embodiments, provided herein are polypeptides encoded by the nucleic acid molecules encoding zSIRs which are part of CARs 7-15 (see, e.g., Table 1), wherein the antigen-specific domains are specific to CD276.

In some embodiments, provided herein are polypeptides encoded by the nucleic acid molecules encoding zSIRs which are part of CARs 7-15 (see, e.g., Table 1), wherein the antigen-specific domains are specific to CD324.

In some embodiments, provided herein are polypeptides encoded by the nucleic acid molecules encoding zSIRs which are part of CARs 7-15 (see, e.g., Table 1), wherein the antigen-specific domains are specific to CS1.

In some embodiments, provided herein are polypeptides encoded by the nucleic acid molecules encoding zSIRs which are part of CARs 7-15 (see, e.g., Table 1), wherein the antigen-specific domains are specific to ALK1.

In some embodiments, provided herein are polypeptides encoded by the nucleic acid molecules encoding zSIRs which are part of CARs 7-15 (see, e.g., Table 1), wherein the antigen-specific domains are specific to ROR1.

In some embodiments, provided herein are polypeptides encoded by the nucleic acid molecules encoding zSIRs which are part of CARs 7-15 (see, e.g., Table 1), wherein the antigen-specific domains are specific to CDH6

In some embodiments, provided herein are polypeptides encoded by the nucleic acid molecules encoding zSIRs which are part of CARs 7-15 (see, e.g., Table 1), wherein the antigen-specific domains are specific to CDH16.

In some embodiments, provided herein are polypeptides encoded by the nucleic acid molecules encoding zSIRs which are part of CARs 7-15 (see, e.g., Table 1), wherein the antigen-specific domains are specific to CDH17.

In some embodiments, provided herein are polypeptides encoded by the nucleic acid molecules encoding zSIRs which are part of CARs 7-15 (see, e.g., Table 1), wherein the antigen-specific domains are specific to Folate Receptor beta.

In some embodiments, provided herein are polypeptides encoded by the nucleic acid molecules encoding zSIRs which are part of CARs 7-15 (see, e.g., Table 1), wherein the antigen-specific domains are specific to CLECSA.

In some embodiments, provided herein are polypeptides encoded by the nucleic acid molecules encoding zSIRs which are part of CARs 7-15 (see, e.g., Table 1), wherein the antigen-specific domains are specific to NY-ESO/MHC class I complex.

In some embodiments, provided herein are polypeptides encoded by the nucleic acid molecules encoding zSIRs which are part of CARs 7-15 (see, e.g., Table 1), wherein the antigen-specific domains are specific to WT1/MHC class I complex.

In some embodiments, provided herein are polypeptides encoded by the nucleic acid molecules encoding zSIRs which are part of CARs 7-15 (see, e.g., Table 1), wherein the antigen-specific domains are specific to AFP/MHC class I complex.

In some embodiments, provided herein are polypeptides encoded by the nucleic acid molecules encoding zSIRs which are part of CARs 7-15 (see, e.g., Table 1), wherein the antigen-specific domains are specific to HPV16-E7/MHC class I complex.

In some embodiments, provided herein are polypeptides encoded by the nucleic acid molecules encoding zSIRs which are part of CARs 7-15 (see, e.g., Table 1), wherein the antigen-specific domains are specific to gp100/MHC class I complex.

In some embodiments, provided herein are polypeptides encoded by the nucleic acid molecules encoding zSIRs which are part of CARs 7-15 (see, e.g., Table 1), wherein the antigen-specific domains are specific to hTERT/MHC class I complex.

In some embodiments, provided herein are polypeptides encoded by the nucleic acid molecules encoding zSIRs which are part of CARs 7-15 (see, e.g., Table 1), wherein the antigen-specific domains are specific to MART1/MHC class I complex.

In some embodiments, provided herein are polypeptides encoded by the nucleic acid molecules encoding zSIRs which are part of CARs 7-15 (see, e.g., Table 1), wherein the antigen-specific domains are specific to HTLV1-Tax/MHC class I complex.

In some embodiments, provided herein are polypeptides encoded by the nucleic acid molecules encoding zSIRs which are part of CARs 7-15 (see, e.g., Table 1), wherein the antigen-specific domains are specific to PR1/MHC class I complex.

In some embodiments, provided herein are polypeptides encoded by the nucleic acid molecules encoding zSIRs which are part of CARs 7-15 (see, e.g., Table 1), wherein the antigen-specific domains are specific to HIV1-gag/MHC class I complex.

In some embodiments, provided herein are polypeptides encoded by the nucleic acid molecules encoding zSIRs which are part of CARs 7-15 (see, e.g., Table 1), wherein the antigen-specific domains are specific to HIV1-envelop gp120.

In some embodiments, provided herein are polypeptides encoded by the nucleic acid molecules encoding zSIRs which are part of CARs 7-15 (see, e.g., Table 1), wherein the antigen-specific domains are specific to PTK7.

In some embodiments, provided herein are polypeptides encoded by the nucleic acid molecules encoding zSIRs which are part of CARs 7-15 (see, e.g., Table 1), wherein the antigen-specific domains are specific to TROP2.

In some embodiments, provided herein are polypeptides encoded by the nucleic acid molecules encoding zSIRs which are part of CARs 7-15 (see, e.g., Table 1), wherein the antigen-specific domains are specific to BAFF-R.

In some embodiments, provided herein are polypeptides encoded by the nucleic acid molecules encoding zSIRs which are part of CARs 7-15 (see, e.g., Table 1), wherein the antigen-specific domains are specific to LAMP1.

In some embodiments, provided herein are polypeptides encoded by the nucleic acid molecules encoding zSIRs which are part of CARs 7-15 (see, e.g., Table 1), wherein the antigen-specific domains are specific to Tim1.

In some embodiments, provided herein are polypeptides encoded by the nucleic acid molecules encoding zSIRs which are part of CARs 7-15 (see, e.g., Table 1), wherein the antigen-specific domains are specific to TCR gamma-delta.

In some embodiments, provided herein are polypeptides encoded by the nucleic acid molecules encoding zSIRs which are part of CARs 7-15 (see, e.g., Table 1), wherein the antigen-specific domains are specific to TCR beta1 constant chain.

In some embodiments, provided herein are polypeptides encoded by the nucleic acid molecules encoding zSIRs which are part of CARs 7-15 (see, e.g., Table 1), wherein the antigen-specific domains are specific to TCR beta2 constant chain.

In some embodiments, provided herein are polypeptides encoded by the nucleic acid molecules encoding zSIRs which are part of CARs 7-15 (see, e.g., Table 1), wherein the antigen-specific domains are specific to GCC.

In some embodiments, provided herein are polypeptides encoded by the nucleic acid molecules encoding zSIRs which are part of CARs 7-15 (see, e.g., Table 1), wherein the antigen-specific domains are specific to B7H4.

In some embodiments, provided herein are polypeptides encoded by the nucleic acid molecules encoding zSIRs which are part of CARs 7-15 (see, e.g., Table 1), wherein the antigen-specific domains are specific to LHR.

In some embodiments, provided herein are polypeptides encoded by the nucleic acid molecules encoding zSIRs which are part of CARs 7-15 (see, e.g., Table 1), wherein the antigen-specific domains are specific to Tn-Muc1.

In some embodiments, provided herein are polypeptides encoded by the nucleic acid molecules encoding zSIRs which are part of CARs 7-15 (see, e.g., Table 1), wherein the antigen-specific domains are specific to TSLPR.

In some embodiments, provided herein are polypeptides encoded by the nucleic acid molecules encoding zSIRs which are part of CARs 7-15 (see, e.g., Table 1), wherein the antigen-specific domains are specific to Tissue Factor.

In some embodiments, provided herein are polypeptides encoded by the nucleic acid molecules encoding zSIRs which are part of CARs 7-15 (see, e.g., Table 1), wherein the antigen-specific domains are specific to SSEA-4.

In some embodiments, provided herein are polypeptides encoded by the nucleic acid molecules encoding zSIRs which are part of CARs 7-15 (see, e.g., Table 1), wherein the antigen-specific domains are specific to SLea.

In some embodiments, provided herein are polypeptides encoded by the nucleic acid molecules encoding zSIRs which are part of CARs 7-15 (see, e.g., Table 1), wherein the antigen-specific domains are specific to Muc1/MHC class I complex.

In some embodiments, provided herein are polypeptides encoded by the nucleic acid molecules encoding zSIRs which are part of CARs 7-15 (see, e.g., Table 1), wherein the antigen-specific domains are specific to Muc16.

In some embodiments, provided herein are polypeptides encoded by the nucleic acid molecules encoding zSIRs which are part of CARs 7-15 (see, e.g., Table 1), wherein the antigen-specific domains are specific to NYBR-1.

In some embodiments, provided herein are polypeptides encoded by the nucleic acid molecules encoding zSIRs which are part of CARs 7-15 (see, e.g., Table 1), wherein the antigen-specific domains are specific to IL13Ra2.

In some embodiments, provided herein are polypeptides encoded by the nucleic acid molecules encoding zSIRs which are part of CARs 7-15 (see, e.g., Table 1), wherein the antigen-specific domains are specific to IL11Ra.

In some embodiments, provided herein are polypeptides encoded by the nucleic acid molecules encoding zSIRs which are part of CARs 7-15 (see, e.g., Table 1), wherein the antigen-specific domains are specific to L1CAM.

In some embodiments, provided herein are polypeptides encoded by the nucleic acid molecules encoding zSIRs which are part of CARs 7-15 (see, e.g., Table 1), wherein the antigen-specific domains are specific to EpCAM1.

In some embodiments, provided herein are polypeptides encoded by the nucleic acid molecules encoding zSIRs which are part of CARs 7-15 (see, e.g., Table 1), wherein the antigen-specific domains are specific to gpNMB.

In some embodiments, provided herein are polypeptides encoded by the nucleic acid molecules encoding zSIRs which are part of CARs 7-15 (see, e.g., Table 1), wherein the antigen-specific domains are specific to GRP78.

In some embodiments, provided herein are polypeptides encoded by the nucleic acid molecules encoding zSIRs which are part of CARs 7-15 (see, e.g., Table 1), wherein the antigen-specific domains are specific to GPC3.

In some embodiments, provided herein are polypeptides encoded by the nucleic acid molecules encoding zSIRs which are part of CARs 7-15 (see, e.g., Table 1), wherein the antigen-specific domains are specific to GRPC5D.

In some embodiments, provided herein are polypeptides encoded by the nucleic acid molecules encoding zSIRs which are part of CARs 7-15 (see, e.g., Table 1), wherein the antigen-specific domains are specific to GFRa4.

In some embodiments, provided herein are polypeptides encoded by the nucleic acid molecules encoding zSIRs which are part of CARs 7-15 (see, e.g., Table 1), wherein the antigen-specific domains are specific to FITC.

In some embodiments, provided herein are polypeptides encoded by the nucleic acid molecules encoding zSIRs which are part of CARs 7-15 (see, e.g., Table 1), wherein the antigen-specific domains are specific to CD79b.

In some embodiments, provided herein are polypeptides encoded by the nucleic acid molecules encoding zSIRs which are part of CARs 7-15 (see, e.g., Table 1), wherein the antigen-specific domains are specific to Lym1.

In some embodiments, provided herein are polypeptides encoded by the nucleic acid molecules encoding zSIRs which are part of CARs 7-15 (see, e.g., Table 1), wherein the antigen-specific domains are specific to Lym2.

In some embodiments, provided herein are polypeptides encoded by the nucleic acid molecules encoding zSIRs which are part of CARs 7-15 (see, e.g., Table 1), wherein the antigen-specific domains are specific to CLD18A2.

In some embodiments, provided herein are polypeptides encoded by the nucleic acid molecules encoding zSIRs which are part of CARs 7-15 (see, e.g., Table 1), wherein the antigen-specific domains are specific to CD43 epitope expressed on leukemia cells.

In some embodiments, provided herein are polypeptides encoded by the nucleic acid molecules encoding zSIRs which are part of CARs 7-15 (see, e.g., Table 1), wherein the antigen-specific domains are specific to CD179a.

In some embodiments, provided herein are polypeptides encoded by the nucleic acid molecules encoding CARs 1-6 (see, e.g., Table 1) or are part of backbones described herein such as backbone-1, backbone-2, backbone-32 or backbone-60, wherein the antigen specific domain is as described in Table 3.

In some embodiments, the nucleic acid molecule encoding the CARs (e.g., CAR I, CAR II, SIR, zSIR, Ab-TCR, TFP and the like) and/or accessory molecules described herein is provided as a messenger RNA (mRNA) transcript. In another embodiment, the nucleic acid molecule encoding the CARs and/or accessory molecules described herein is provided as a DNA construct.

Also provided are vectors comprising the polynucleotides described herein. In some embodiments, the vectors are viral vectors. Examples of viral vectors include but are not limited to retrovirus, an adenovirus, an adeno-associated virus, a lentivirus, a pox virus, a herpes virus vector or a sleeping beauty transposon vector. In various embodiments, the disclosure includes retroviral and lentiviral vector constructs expressing the CAR (e.g., CAR I, CAR II, SIR, zSIR, Ab-TCR, TFP and the like) and the accessory molecules that can be directly transduced into a cell.

The disclosure also includes an RNA construct that can be directly transfected into a cell. A method for generating mRNA for use in transfection involves in vitro transcription (IVT) of a template with specially designed primers, followed by polyA addition, to produce a construct containing 3' and 5' untranslated sequence ("UTR") (e.g., a 3' and/or 5' UTR described herein), a 5' cap (e.g., a 5' cap described herein) and/or Internal Ribosome Entry Site (IRES) (e.g., an IRES described herein), the nucleic acid to be expressed, and a polyA tail, typically 50-2000 bases in length. RNA so produced can efficiently transfect different kinds of cells. In one embodiment, the template includes sequences for the CAR (e.g., CAR I, CAR II, SIR, zSIR, Ab-TCR, TFP and the like). In an embodiment, an RNA CAR or next generation CAR vector is transduced into a cell, e.g., a T cell or a NK cell, by electroporation. In another embodiment, an RNA CAR or next generation CAR vector is transduced into a cell, e.g., a T cell or a NK cell, by causing transient perturbations in cell membrane using a microfluid device as described in patent application WO 2013/059343 A1 (PCT/US2012/060646). The polynucleotide sequences coding for the desired molecules can be obtained using recombinant methods known in the art, for example by screening libraries from cells expressing the gene, by deriving the gene from a vector known to include the same, or by isolating directly from cells and tissues containing the same, using standard techniques. Alternatively, the gene of interest can be produced synthetically, rather than cloned.

The disclosure also provides vectors in which a DNA encoding the CARs (e.g., CAR I, CAR II, SIR, zSIR, Ab-TCR, TFP and the like) of the disclosure is inserted. Vectors derived from retroviruses such as the lentivirus are suitable tools to achieve long-term gene transfer since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. Exemplary lentiviral vectors are provided in SEQ ID NOs: 129-130 and 12639. A retroviral vector may also be, e.g., a gammaretroviral vector. A gammaretroviral vector may include, e.g., a promoter, a packaging signal (ψ), a primer binding site (PBS), one or more (e.g., two) long terminal repeats (LTR), and a transgene of interest, e.g., a gene encoding a CAR (e.g., CAR I, CAR II, SIR, zSIR, Ab-TCR, TFP and the like). Exemplary gammaretroviral vectors include Murine Leukemia Virus (MLV), Spleen-Focus Forming Virus (SFFV), and Myeloproliferative Sarcoma Virus (MPSV), and vectors derived therefrom. In another embodiment, the vector comprising the nucleic acid encoding the desired CAR (e.g., CAR I, CAR II, SIR, zSIR, Ab-TCR, TFP and the like) of the disclosure is an adenoviral vector (A5/35).

The expression of natural or synthetic nucleic acids encoding CARs (e.g., CAR I, CAR II, SIR, zSIR, Ab-TCR, TFP and the like) is typically achieved by operably linking a nucleic acid encoding the CAR (e.g., CAR I, CAR II, SIR, zSIR, Ab-TCR, TFP and the like) polypeptide or portions thereof to a promoter, and incorporating the construct into an expression vector. Exemplary lentiviral vector encoding CAR of the disclosure are provided in SEQ ID Nos: 12640-41 and 14378, 14380-85. The vectors can be suitable for replication and integration in eukaryotes. Typical cloning vectors contain transcription and translation terminators, initiation sequences, and promoters useful for regulation of the expression of the desired nucleic acid sequence. The vector may contain a single promoter or more than one promoter. In some embodiments, the two or more functional units of a CAR (e.g., nucleotides encoding two functional polypeptide units of a SIR or a zSIR or an Ab-TCR) are under the control of separate promoters. The expression constructs of the disclosure may also be used for nucleic acid immunization and gene therapy, using standard gene delivery protocols. Methods for gene delivery are known in the art. See, e.g., U.S. Pat. Nos. 5,399,346, 5,580,859, 5,589,466, incorporated by reference herein in their entireties.

Cloning and expression methods will be apparent to a person of skill in the art.

Physical methods for introducing polynucleotides of into host cells such as calcium phosphate transfection and the like are well known in the art and will be apparent to a person of skill in the art. In another embodiment, a CAR (e.g., CAR I, CAR II, SIR, zSIR, Ab-TCR, TFP and the like) vector is transduced into a cell, e.g., a T cell or a NK cell, by causing transient perturbations in cell membrane using a microfluid device as described in patent application WO 2013/059343 A1 (PCT/US2012/060646) and in Ding X et al., Nat. Biomed. Eng. 1, 0039 (2017) the contents of each of which are herein incorporated by reference in their entirety as though set forth herein.

In various embodiments, the cells for modifications with CARs (e.g., CAR I, CAR II, SIR, zSIR, Ab-TCR, TFP and the like) described herein, including T cells or NK cells may be obtained from a subject desiring therapy. T cells can be obtained from a number of sources, including peripheral blood mononuclear cells, bone marrow, lymph node tissue, cord blood, placenta, thymus tissue, tissue from a site of infection, ascites, pleural effusion, spleen tissue, and tumors. T cells could be tissue resident gamma-delta T cells, which can be cultured and expanded in vitro prior to expression of the CAR (e.g., CAR I, CAR II, SIR, zSIR, Ab-TCR, TFP and the like).

In one aspect, the disclosure provides a number of CARs (e.g., CAR I, CAR II, SIR, zSIR, Ab-TCR, TFP and the like) comprising an antigen binding domain (e.g., antibody or antibody fragment, TCR or TCR fragment) engineered for specific binding to a disease-associated antigen, e.g., a tumor antigen described herein. In one aspect, the disclosure provides an immune effector cell (e.g., T cell, NKT cell) engineered to express a CAR (e.g., CAR I, CAR II, SIR, zSIR, Ab-TCR, TFP and the like), wherein the engineered immune effector cell exhibits a therapeutic property. In one aspect, the disclosure provides an immune effector cell (e.g., T cell, NKT cell) engineered to express a CAR (e.g., CAR I, CAR II, SIR, zSIR, Ab-TCR, TFP and the like), wherein the engineered immune effector cell exhibits an anticancer property. In one embodiment, a cell is transformed with the CAR (e.g., CAR I, CAR II, SIR, zSIR, Ab-TCR, TFP and the like) and the CAR (e.g., CAR I, CAR II, SIR, zSIR, Ab-TCR, TFP and the like) is expressed on the cell surface. In some embodiments, the cell (e.g., T cell, NKT cell) is transduced with a viral vector encoding a CAR (e.g., SIR, zSIR, Ab-TCR, TFP and the like). In some embodiments, the viral vector is a retroviral vector. In some embodiments, the viral vector is a lentiviral vector. In some such embodiments, the cell may stably express the CAR (e.g., CAR I, CAR II, SIR, zSIR, Ab-TCR, TFP and the like). In another embodiment, the cell (e.g., T cell, NKT cell) is transfected with a nucleic acid, e.g., mRNA, cDNA, DNA, encoding a CAR or next generation CAR (e.g., CAR I, CAR II, SIR, zSIR, Ab-TCR, TFP and the like). In some such embodiments, the cell may transiently express the CAR (e.g., CAR I, CAR II, SIR, zSIR, Ab-TCR, TFP and the like).

The disclosure provides immune effector cells (e.g., T cells, NKT or NK cells) that are engineered to contain one or more CARs (e.g., CAR I, CAR II, SIR, zSIR, Ab-TCR, TFP and the like) that direct the immune effector cells to diseased cells or disease-associated cells, such as cancer cells. This is achieved through an antigen binding domain on the CAR (e.g., SIR, zSIR, Ab-TCR, Tri-Tac, TFP and the like) that is specific for a cancer associated antigen. There are two classes of cancer associated antigens (tumor antigens) that can be targeted by the CARs (e.g., CAR I, CAR II, SIR, zSIR, Ab-TCR, Tri-Tac, TFP and the like) of the disclosure: (1) cancer associated antigens that are expressed on the surface of cancer cells; and (2) cancer associated antigens that itself is intracellular, however, a fragment of such antigen (peptide) is presented on the surface of the cancer cells by MHC (major histocompatibility complex).

Furthermore, the disclosure provides CAR—(e.g., CAR I, CAR II, SIR, zSIR, Ab-TCR, TFP and the like)-expressing cells and their use in medicaments or methods for treating, among other diseases, cancer or any malignancy or autoimmune diseases or infectious disease or degenerative disease or allergic disease involving cells or tissues which express a tumor antigen or disease associated antigen as described herein.

In one aspect, the disclosure provides an immune effector cell (e.g., T cell, NKT, or NK cell) engineered to express a CAR or next generation CAR (e.g., CAR I, CAR II, SIR, zSIR, Ab-TCR, TFP and the like), wherein the engineered immune effector cell exhibits an anti-disease property, such as antitumor property. In one embodiment, the antigen is a cancer associated antigen (i.e., tumor antigen) described herein. In one aspect, the antigen binding domain of the CAR (e.g., CAR I, CAR II, SIR, zSIR, Ab-TCR, TFP and the like) comprises a partially humanized antibody fragment. In one aspect, the antigen binding domain of the CAR (e.g., CAR I, CAR II, SIR, zSIR, Ab-TCR, TFP and the like) comprises a partially humanized scFv. Accordingly, the disclosure provides CARs (e.g., CAR I, CAR II, SIR, zSIR, Ab-TCR, TFP and the like) that comprises a humanized antigen binding domain and is engineered into a cell, e.g., a T cell or a NK cell, and methods of their use for adoptive therapy.

Further provided herein are genetically engineered cells, comprising the polynucleotides and/or the CAR (e.g., CAR I, CAR II, SIR, zSIR, Ab-TCR, TFP and the like) described herein. In some embodiments, the cell is a T-lymphocyte (T-cell). In some embodiment the cell is a naïve T cells, a central memory T cells, an effector memory T cell, a regulatory T cell (Treg) or a combination thereof. In some embodiments, the cell is a natural killer (NK) cell, a hematopoietic stem cell (HSC), an embryonic stem cell, or a pluripotent stem cell. Genetically engineered cells which may comprise and express the CARs of the disclosure include, but are not limited to, T-lymphocytes (T-cells), naïve T cells (TN), memory T cells (for example, central memory T cells (TCM), effector memory cells (TEM)), natural killer cells, hematopoietic stem cells and/or pluripotent embryonic/induced stem cells capable of giving rise to therapeutically relevant progeny. In an embodiment, the genetically engineered cells are autologous cells. In an embodiment, the genetically engineered cells are allogeneic cells. By way of example, individual T-cells of the disclosure may be CD4+/CD8−, CD4−/CD8+, CD4−/CD8− or CD4+/CD8+. The T-cells may be a mixed population of CD4+/CD8− and CD4−/CD8+ cells or a population of a single clone. CD4+ T-cells of the disclosure may produce IL-2, IFN, TNF and other T-cell effector cytokines when co-cultured in vitro with cells expressing the target antigens (for example CD20+ and/or CD19+ tumor cells). CD8+ T-cells of the disclosure may lyse antigen-specific target cells when co-cultured in vitro with the target cells. In some embodiments, T cells may be any one or more of CD45RA+ CD62L+naïve cells, CD45RO+CD62L+ central memory cells, CD62L-effector memory cells or a combination thereof (Berger et al., Adoptive transfer of virus-specific and tumor-specific T cell immunity, Curr Opin Immunol, 2009, 21(2)224-232). Genetically modified cells may be produced by stably transfecting cells with DNA encoding the CAR (e.g., SIR, zSIR, Ab-TCR, TFP and the like) of the disclosure.

The genetically engineered cells may be engineered to knock-out the expression of the endogenous TCR chains, e.g., TCRα, TCRβ, TCRγ, TCRδ or pre-TCRα chains. The knock-out of the endogenous TCRα, TCRβ, TCRγ, TCRδ or pre-TCRα chains can be achieved using a number of techniques known in the art, such as the use of CRISP/Cas9 and Zn finger nucleases. In an exemplary embodiment, gRNAs targeting TCRα and TCRβ loci can be introduced into T cells or iPSC or stem cell along with Cas9 mRNA to knock out the expression of endogenous TCRα and TCRβ chains. Such TCRα/β knock-out cells can be used to introduce the CARs of the disclosure. A T cell lacking a functional endogenous TCR can be engineered such that it does not express any functional endogenous TCR on its surface, e.g., engineered such that it does not express one or more subunits (e.g. constant chains of endogenous TCRα, TCRβ1, TCRβ2, TCRγ, TCRδ or pre-TCRα) that comprise a functional endogenous TCR or engineered such that it produces very little functional endogenous TCR on its surface. Alternatively, the T cell can express a substantially impaired endogenous TCR, e.g., by expression of mutated or truncated forms of one or more of the subunits of the TCR. The term "substantially impaired TCR" means that this TCR will not elicit an adverse immune reaction in a host. In one embodiment, the allogeneic T cell or allogeneic NKT cell lacks expression or has low expression of a functional TCR and/or a functional HLA.

Various methods produce stable transfectants which express the CARs (e.g., CAR I, CAR II, SIR, zSIR, Ab-TCR, TFP and the like) of the disclosure. In one embodiment, a method of stably transfecting and re-directing cells is by electroporation using naked DNA. By using naked DNA, the time required to produce redirected cells may be significantly reduced. Additional methods to genetically engineer cells using naked DNA encoding the CAR (e.g., CAR I, CAR II, SIR, zSIR, Ab-TCR, TFP and the like) of the disclosure include, but are not limited to, chemical transformation methods (e.g., using calcium phosphate, dendrimers, liposomes and/or cationic polymers), non-chemical transformation methods (e.g., electroporation, optical transformation, gene electrotransfer, transient perturbation in cell membranes and/or hydrodynamic delivery) and/or particle-based methods (e.g., impalefection, using a gene gun and/or magnetofection). The transfected cells demonstrating presence of a single integrated un-rearranged vector and expression of the CAR (e.g., CAR I, CAR II, SIR, zSIR, Ab-TCR, TFP and the like) may be expanded ex vivo. In one embodiment, the cells selected for ex vivo expansion are CD8+ and demonstrates the capacity to specifically recognize and lyse antigen-specific target cells.

Viral transduction methods may also be used to generate redirected cells which express the CAR (e.g., CAR I, CAR II, SIR, zSIR, Ab-TCR, TFP and the like) of the disclosure. Cell types that may be used to generate genetically modified cells expressing the CAR (e.g., CAR I, CAR II, SIR, zSIR, Ab-TCR, TFP and the like) of the disclosure include but are not limited to T-lymphocytes (T-cells), natural killer cells, hematopoietic stem cells and/or pluripotent embryonic/induced stem cells capable of giving rise to therapeutically relevant progeny.

Stimulation of the T-cells by an antigen under proper conditions results in proliferation (expansion) of the cells and/or production of IL-2. The cells comprising the CAR (e.g., CAR I, CAR II, SIR, zSIR, Ab-TCR, TFP and the like) of the disclosure will expand in number in response to the binding of one or more antigens to the antigen-specific targeting regions of the CAR (e.g., CAR I, CAR II, SIR, zSIR, Ab-TCR, TFP and the like). The disclosure also provides a method of making and expanding cells expressing a CAR (e.g., CAR I, CAR II, SIR, zSIR, Ab-TCR, TFP and the like). The method comprises transfecting or transducing the cells with the vector expressing the CAR (e.g., CAR I, CAR II, SIR, zSIR, Ab-TCR, TFP and the like) and stimulating the cells with cells expressing the target antigens, recombinant target antigens, or an antibody to the receptor to cause the cells to proliferate, so as to make and expand T-cells. In an embodiment, the cells may be any one or more of T-lymphocytes (T-cells), natural killer (NK) T cells, hematopoietic stem cells (HSCs) or pluripotent embryonic/induced stem cells capable of giving rise to therapeutically relevant progeny.

In some embodiments, genetically engineered cells described herein express the various backbones described herein, wherein the CAR (e.g., CAR I, CAR II, SIR, zSIR, Ab-TCR, TFP and the like) component of the backbone determines target specificity based on the antigen specific domain of the CAR (e.g., CAR I, CAR II, SIR, zSIR, Ab-TCR, TFP and the like).

In one embodiment, the genetically engineered cells comprise nucleic acid molecules encoding CARs 1 to 15 (see, e.g., Table 1) which are part of the backbones described herein, such as backbone-1, backbone-2, backbone-32 or backbone-60, wherein the antigen-specific domain of the CARs is specific to an antigen target in Table 3 and/or 7 and comprises the antigen binding domain sequences set forth in Table 3 and/or 7.

In one embodiment, the genetically engineered cells comprise nucleic acid molecules encoding zSIRs which are part of CARs 7-15 (see, e.g., Table 1), wherein the antigen-specific domains are specific to MPL.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to MPL.

In one embodiment, the genetically engineered cells comprise nucleic acid molecules encoding zSIRs which are part of CARs 7-15 (see, e.g., Table 1), wherein the antigen-specific domains are specific to CD19.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to CD19.

In one embodiment, the genetically engineered cells comprise nucleic acid molecules encoding zSIRs which are part of CARs 7-15 (see, e.g., Table 1), wherein the antigen-specific domains are specific to CD20.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to CD20.

In one embodiment, the genetically engineered cells comprise nucleic acid molecules encoding zSIRs which are part of CARs 7-15 (see, e.g., Table 1), wherein the antigen-specific domains are specific to BCMA.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to BCMA.

In one embodiment, the genetically engineered cells comprise nucleic acid molecules encoding zSIRs which are part of CARs 7-15 (see, e.g., Table 1), wherein the antigen-specific domains are specific to CD22.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to CD22.

In one embodiment, the genetically engineered cells comprise nucleic acid molecules encoding zSIRs which are part of CARs 7-15 (see, e.g., Table 1), wherein the antigen-specific domains are specific to BAFF-R.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to BAFF-R.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to Integrin B7.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to Nectin 4.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to Prolactin Receptor.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to Muc17.

In one embodiment, the genetically engineered cells comprise nucleic acid molecules encoding zSIRs which are part of CARs 7-15 (see, e.g., Table 1), wherein the antigen-specific domains are specific to CD70.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to CD70.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to VISTA.

In one embodiment, the genetically engineered cells comprise nucleic acid molecules encoding zSIRs which are part of CARs 7-15 (see, e.g., Table 1), wherein the antigen-specific domains are specific to GPC3.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to GPC3.

In one embodiment, the genetically engineered cells comprise nucleic acid molecules encoding zSIRs which are part of CARs 7-15 (see, e.g., Table 1), wherein the antigen-specific domains are specific to EMR2.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to EMR2.

In one embodiment, the genetically engineered cells comprise nucleic acid molecules encoding zSIRs which are part of CARs 7-15 (see, e.g., Table 1), wherein the antigen-specific domains are specific to gpNMB.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to RNF43.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to STEAP1.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to Robo4.

In one embodiment, the genetically engineered cells comprise nucleic acid molecules encoding zSIRs which are part of CARs 7-15 (see, e.g., Table 1), wherein the antigen-specific domains are specific to CLDN6.

In one embodiment, the genetically engineered cells comprise nucleic acid molecules encoding zSIRs which are part of CARs 7-15 (see, e.g., Table 1), wherein the antigen-specific domains are specific to CD44v6.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to MMP16.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to UPK1B.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to BMPR1B.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to Ly6E.

In one embodiment, the genetically engineered cells comprise nucleic acid molecules encoding zSIRs which are part of CARs 7-15 (see, e.g., Table 1), wherein the antigen-specific domains are specific to CD79b.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to CD79b.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to WISP1.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to Cripto.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to gpA33.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to IL1RAP.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to BST1.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to CD133.

In one embodiment, the genetically engineered cells comprise nucleic acid molecules encoding zSIRs which are part of CARs 7-15 (see, e.g., Table 1), wherein the antigen-specific domains are specific to CD123.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to CD123.

In one embodiment, the genetically engineered cells comprise nucleic acid molecules encoding zSIRs which are part of CARs 7-15 (see, e.g., Table 1), wherein the antigen-specific domains are specific to CD138.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to CD138.

In one embodiment, the genetically engineered cells comprise nucleic acid molecules encoding zSIRs which are part of CARs 7-15 (see, e.g., Table 1), wherein the antigen-specific domains are specific to CLL1.

In one embodiment, the genetically engineered cells comprise nucleic acid molecules encoding CARs 1 to 15 which are part of the backbones described herein, such as backbone-1, backbone-2, backbone-32 or backbone-60, wherein the antigen-specific domain of the CARs is specific to CLL1.

In one embodiment, the genetically engineered cells comprise nucleic acid molecules encoding zSIRs which are part of CARs 7-15 (see, e.g., Table 1), wherein the antigen-specific domains are specific to TCR-beta1 constant chain.

In one embodiment, the genetically engineered cells comprise nucleic acid molecules encoding zSIRs which are part of CARs 7-15 (see, e.g., Table 1), wherein the antigen-specific domains are specific to TCR-beta2 constant chain.

In one embodiment, the genetically engineered cells comprise nucleic acid molecules encoding zSIRs which are part of CARs 7-15 (see, e.g., Table 1), wherein the antigen-specific domains are specific to ALK.

In one embodiment, the genetically engineered cells comprise nucleic acid molecules encoding zSIRs which are part of CARs 7-15 (see, e.g., Table 1), wherein the antigen-specific domains are specific to PTK7.

In one embodiment, the genetically engineered cells comprise nucleic acid molecules encoding zSIRs which are part of CARs 7-15 (see, e.g., Table 1), wherein the antigen-specific domains are specific to DLL3.

In one embodiment, the genetically engineered cells comprise nucleic acid molecules encoding zSIRs which are part of CARs 7-15 (see, e.g., Table 1), wherein the antigen-specific domains are specific to TROP2.

In one embodiment, the genetically engineered cells comprise nucleic acid molecules encoding zSIRs which are part of CARs 7-15 (see, e.g., Table 1), wherein the antigen-specific domains are specific to Tim1.

In one embodiment, the genetically engineered cells comprise nucleic acid molecules encoding zSIRs which are part of CARs 7-15 (see, e.g., Table 1), wherein the antigen-specific domains are specific to LAMP1.

In one embodiment, the genetically engineered cells comprise nucleic acid molecules encoding zSIRs which are part of CARs 7-15 (see, e.g., Table 1), wherein the antigen-specific domains are specific to CS1.

In one embodiment, the genetically engineered cells comprise nucleic acid molecules encoding zSIRs which are part of CARs 7-15 (see, e.g., Table 1), wherein the antigen-specific domains are specific to Lym1.

In one embodiment, the genetically engineered cells comprise nucleic acid molecules encoding zSIRs which are part of CARs 7-15 (see, e.g., Table 1), wherein the antigen-specific domains are specific to Lym2.

In one embodiment, the genetically engineered cells comprise nucleic acid molecules encoding zSIRs which are part of CARs 7-15 (see, e.g., Table 1), wherein the antigen-specific domains are specific to TSHR.

In one embodiment, the genetically engineered cells comprise nucleic acid molecules encoding zSIRs which are part of CARs 7-15 (see, e.g., Table 1), wherein the antigen-specific domains are specific to NY-ESO/MHC class I complex.

In one embodiment, the genetically engineered cells comprise nucleic acid molecules encoding zSIRs which are part of CARs 7-15 (see, e.g., Table 1), wherein the antigen-specific domains are specific to WT1/MHC class I complex.

In one embodiment, the genetically engineered cells comprise nucleic acid molecules encoding zSIRs which are part of CARs 7-15 (see, e.g., Table 1), wherein the antigen-specific domains are specific to Ras/MHC class I complex.

In one embodiment, the genetically engineered cells comprise nucleic acid molecules encoding zSIRs which are part of CARs 7-15 (see, e.g., Table 1), wherein the antigen-specific domains are specific to CD179a.

In one embodiment, the genetically engineered cells comprise nucleic acid molecules encoding zSIRs which are part of CARs 7-15 (see, e.g., Table 1), wherein the antigen-specific domains are specific to CLD18A2.

In one embodiment, the genetically engineered cells comprise nucleic acid molecules encoding zSIRs which are part of CARs 7-15 (see, e.g., Table 1), wherein the antigen-specific domains are specific to CD43 epitope expressed on leukemia cells.

In one embodiment, the genetically engineered cells comprise nucleic acid molecules encoding zSIRs which are part of CARs 7-15 (see, e.g., Table 1), wherein the antigen-specific domains are specific to HIV1 envelop glycoprotein gp120.

In one embodiment, the genetically engineered cells comprise nucleic acid molecules encoding zSIRs which are part of CARs 7-15 (see, e.g., Table 1), wherein the antigen-specific domains are specific to Fc region of an immunoglobulin.

In one embodiment, the CAR-expressing effector cell described herein can further comprise a second CAR that may include a different antigen binding domain to the same or a different target. In some embodiments, the second CAR may target the same or a different cell type from the first CAR. In some embodiment, the second CAR may be of the same class (i.e., CAR 1 to CAR 15) as the first CAR. In some embodiment, the second CAR is of a different class as the first CAR. In some embodiment, the second CAR has the same backbone as the first CAR. In some embodiment, the second CAR has a different backbone as the first CAR.

In one embodiment, the CAR (e.g., a CAR 7-15)-expressing effector cell described herein can further comprise a CAR of a different class (e.g., CAR 1 or CAR 2 etc.) with the same or a different antigen binding domain, optionally the same or a different target. In some embodiments, the second CAR (e.g., a CAR 1, CAR 2 etc.) may target the same or a different cell type from the first CAR (e.g., a CAR 7-15). In one embodiment, the CAR includes an antigen binding domain to a target expressed on the same disease cell type (e.g. cancer) as the disease associated antigen. In one embodiment, the CAR (e.g., a CAR 7-15, e.g., a zSIR) expressing cell comprises a CAR that targets a first antigen, and a second antigen specific receptor (e.g., a CAR) that targets a second, different, antigen and includes an intracellular signaling domain having no primary signaling domain but a costimulatory signaling domain. While not wishing to be bound by theory, placement of a costimulatory signaling domain, e.g., 4-1BB, CD28, CD27 or OX-40, onto an antigen specific receptor, can modulate the CAR (e.g., a CAR 7-15, e.g., a zSIR) activity on cells where both targets are expressed. In one embodiment, the CAR (e.g., a CAR 7-15, e.g., a zSIR) expressing cell comprises i) a first disease associated antigen CAR that includes one or more antigen binding domains that bind a target antigen described herein, and ii) a CAR that targets a different target antigen (e.g., an antigen expressed on that same disease associated (e.g. cancer) cell type as the first target antigen) and includes an antigen binding domain, a transmembrane domain and a primary signaling domain and a costimulatory domain. The nucleic acid and amino acid sequences of an exemplary construct with this configuration are presented in SEQ ID NO: 14380 and SEQ ID NO: 16124, respectively. The antigen binding domains of the SIR in this construct are comprised of the vL and vH fragments derived from BCMAAm06 monoclonal antibody that targets BCMA, while the antigen binding domain of the CAR is comprised of the extracellular domain of PD1. The primary signaling domain of the CAR in this construct comprises of CD3z cytosolic domain while the costimulatory domain comprises of the 4-1BB cytosolic domain. In another embodiment, the CAR (e.g., a CAR 7-15, e.g., a zSIR) expressing cell comprises i) a first disease associated antigen CAR that includes one or more antigen binding domains that bind a target antigen described herein, and ii) a CAR that targets a different target antigen (e.g., an antigen expressed on that same disease associated (e.g. cancer) cell type as the first target antigen) and includes an antigen binding domain, a transmembrane domain and a costimulatory domain but without a primary signaling or activation domain. The nucleic acid and amino acid sequences of an exemplary construct with this configuration are presented in SEQ ID NO: 14379 and SEQ ID NO: 16123, respectively. This construct is similar to the construct shown in SEQ ID NO: 14380 with the exception that the CAR lacks the CD3z domain. In yet another embodiment, the CAR (e.g., a CAR 7-15, e.g., a zSIR) expressing cell comprises i) a first disease associated antigen CAR that includes one or more antigen binding domains that bind a target antigen described herein, and ii) a CAR that targets a different target antigen (e.g., an antigen expressed on that same disease associated (e.g. cancer) cell type as the first target antigen) and includes an antigen binding domain, a transmembrane domain and a primary signaling domain but without a costimulatory domain.

In one embodiment, the CAR comprises the antigen binding domain, a transmembrane domain and an intracellular signaling domain (such as but not limited to one or more intracellular signaling domain from 41BB, CD27, OX40, CD28, Dap10, CD2, CD5, ICAM-1, LFA-1, Lck, TNFR-1, TNFR-II, Fas, CD30, CD40 or combinations thereof) and/or a primary signaling domain (such as but not limited to a CD3 zeta signaling domain). Exemplary SIRs co-expressing a CAR are presented in SEQ ID NO: 3217 to 3219 and SEQ ID NO: 3221 and 3222.

Immune effector cells such as T cells and NK cells comprising CARs as described herein may be activated and expanded generally using methods as described, for example, in U.S. Pat. Nos. 6,352,694; 6,534,055; 6,905,680; 6,692,964; 5,858,358; 6,887,466; 6,905,681; 7,144,575; 7,067,318; 7,172,869; 7,232,566; 7,175,843; 5,883,223; 6,905,874; 6,797,514; 6,867,041; and U.S. Patent Application Publication No. 20060121005.

Provided herein are methods for treating a disease associated with expression of a disease-associated antigen or a cancer associated antigen.

In one embodiment, provided herein are methods for treating a disease in a subject in need thereof by administering to the subject a therapeutically effective amount of genetically modified cells described herein (such as T cells, NK cells) that are engineered to express an antigen-specific CAR (e.g., CAR I, CAR II, SIR, zSIR, Ab-TCR, TFP and the like) alone or an antigen specific CAR (e.g., CAR I, CAR II, SIR, zSIR, Ab-TCR. TFP and the like) and an accessory molecule, wherein the antigen is a disease specific antigen as described herein, and wherein the disease causing or disease-associated cells express the said disease-specific antigen.

In one embodiment, provided herein are methods for treating cancer in a subject in need thereof by administering to the subject a therapeutically effective amount of genetically modified cells described herein (such as T cells, NK cells) that are engineered to express an antigen-specific CAR (e.g., CAR I, CAR II, SIR, zSIR, Tri-Tac, Ab-TCR, TFP and the like) alone or an antigen specific CAR (e.g., CAR I, CAR II, SIR, zSIR. Ab-TCR, TFP and the like) and an accessory molecule, wherein the antigen is a cancer specific antigen as described herein, and wherein the cancer cells express the said tumor antigen.

In one embodiment, the cancer specific antigen is expressed on both normal cells and cancers cells, but is expressed at lower levels on normal cells. In one embodiment, the method further comprises selecting a CAR (e.g., CAR I, CAR II, SIR, zSIR, Ab-TCR, TFP and the like) that binds the cancer specific antigen of interest with an affinity that allows the antigen specific CAR to bind and kill the cancer cells. In some embodiments, the antigen specific CAR (e.g., CAR I, CAR II, SIR, zSIR, Ab-TCR, TFP and the like) kills cancer cells but kills less than 30%, 25%, 20%, 15%, 10%, 5% or less of the normal cells expressing the cancer antigen. In exemplary embodiments, the percentage of cells killed by the antigen specific CARs may be determined using the cell death assays (e.g., Matador assay) described herein.

In some embodiment, the disclosure provides methods of treating cancer in a subject in need thereof comprising administering to the subject a therapeutically effective amount of the genetically modified cells (e.g., T cells, NK cells) that are engineered to express conventional CARs 1 to 15, wherein the ASD of the CARs is specific to the antigen that is expressed on cancer cells (for example, the antigen is expressed at lower levels on normal cells relative to cancer cells) and whose SEQ ID NO is listed in Table 3.

In some embodiment, the disclosure provides methods of treating cancer in a subject in need thereof comprising administering to the subject a therapeutically effective amount of the genetically modified cells (e.g., T cells, NK cells) that are engineered to express backbone-1 comprising the conventional CARs I and the accessory module K13-vFLIP, wherein the ASD of the CARs is specific to the antigen that is expressed on cancer cells (for example, the antigen is expressed at lower levels on normal cells relative to cancer cells) and whose SEQ ID NO is listed in Table 3.

In some embodiment, the disclosure provides methods of treating cancer in a subject in need thereof comprising administering to the subject a therapeutically effective amount of the genetically modified cells (e.g., T cells, NK cells) that are engineered to comprising backbone-12 comprising the conventional CARs I and the accessory module HIV1-Vif, wherein the ASD of the CARs is specific to the antigen that is expressed on disease causing or disease associated cells (for example, the antigen is expressed at lower levels on normal cells relative to cancer cells).

In some embodiment, the disclosure provides methods of treating cancer in a subject in need thereof comprising administering to the subject a therapeutically effective amount of the genetically modified cells (e.g., T cells, NK cells) that are engineered to comprising backbone-32 comprising the conventional CAR II and the accessory module K13-vFLIP, wherein the ASD of the CARs is specific to the antigen that is expressed on cancer cells (for example, the antigen is expressed at lower levels on normal cells relative to cancer cells).

In exemplary embodiments, the antigens that may be targeted for the therapeutic methods described herein include but are not limited to any one, two, three, four or more of: CD19; CD5, CD123; CD22; CD30; CD171; CS1 (also referred to as CD2 subset 1, CRACC, SLAMF7, CD319, and 19A24); C-type lectin-like molecule-1 (CLL-1 or CLECL1); BAFF-R; CD33; epidermal growth factor receptor variant III (EGFRviii); ganglioside G2 (GD2); ganglioside GD3 (aNeu5Ac(2-8)aNeu5Ac(2-3)bDGalp(1-4) bDGlcp(1-1)Cer); TNF receptor family member B cell maturation (BCMA); Tn antigen ((Tn Ag) or (GaNAcα-Ser/Thr)); prostate-specific membrane antigen (PSMA); Receptor tyrosine kinase-like orphan receptor 1 (ROR1); Fms Like Tyrosine Kinase 3 (FLT3); Tumor-associated glycoprotein 72 (TAG72); CD38; CD44v6; a glycosylated CD43 epitope expressed on acute leukemia or lymphoma but not on hematopoietic progenitors, a glycosylated CD43 epitope expressed on non-hematopoietic cancers, Carcinoembryonic antigen (CEA); Epithelial cell adhesion molecule (EP-CAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha (FRa or FR1); Folate receptor beta (FRb); Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CA1X); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); sialyl Lewis adhesion molecule (sLe); ganglioside GM3 (aNeu5Ac(2-3)bDClalp(1-4)bDGlcp(1-1) Cer); transglutaminase 5 (TGSS); high molecular weight-melanoma associated antigen (HMWMAA); o-acetyl-GD2 ganglioside (OAcGD2); tumor endothelial marker 1 (TEM1/CD248); tumor endothelial marker 7-related (TEM7R); claudin 6 (CLDN6); thyroid stimulating hormone receptor (TSHR); G protein coupled receptor class C group 5, member D (GPRCSD); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ES0-1); Cancer/testis antigen 2 (LAGE-1a); Melanomaassociated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; survivin; telomerase; prostate carcinoma tumor antigen-1 (PCT A-1 or Galectin 8), melanoma antigen recognized by T cells 1 (MelanA or MARTI); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin Bl; v-myc avian myelocytomatosis viral oncogene neuroblastoma derived homolog (MYCN); Ras Homolog Family Member C (RhoC); Tyrosinase-related protein 2 (TRP-2); Cytochrome P4501B 1 (CYP1B 1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAXS); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIRD; Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1), MPL, Biotin, c-MYC epitope Tag, CD34, LAMP1 TROP2, GFRalpha4, CDH17, CDH6, NYBR1, CDH19, CD200R, Slea (CA19.9; Sialyl Lewis Antigen); Fucosyl-GM1, PTK7, gpNMB, CDH1-CD324, DLL3, CD276/B7H3, IL11Ra, IL13Ra2, CD179b-IGL11, TCRgamma-delta, NKG2D, CD32 (FCGR2A), Tn ag, Timl-/HVCR1, CSF2RA (GM-CSFR-alpha), TGFbetaR2, Lews Ag, TCR-beta1 chain, TCR-beta2 chain, TCR-gamma chain, TCR-delta chain, FITC, Leutenizing hormone receptor (LHR), Follicle stimulating hormone receptor (FSHR), Gonadotropin Hormone receptor (CGHR or GR), CCR4, GD3, SLAMF6, SLAMF4, HIV1 envelope glycoprotein, HTLV1-Tax, CMV pp65, EBV-EBNA3c, KSHV K8.1, KSHV-gH, influenza A hemagglutinin (HA), GAD, PDL1, Guanylyl cyclase C (GCC), auto antibody to desmoglein 3 (Dsg3), auto antibody to desmoglein 1 (Dsg1), HLA, HLA-A, HLA-A2, HLA-B, HLA-C, HLA-DP, HLA-DM, HLA-DOA, HLA-DOB, HLA-DQ, HLA-DR, HLA-G, IgE, CD99, Ras G12V, Tissue Factor 1 (TF1), AFP, GPRCSD, Claudin18.2 (CLD18A2 or CLDN18A.2), CLDN6, P-glycoprotein, STEAP1, Liv1, Nectin-4, Cripto, MPL, gpA33, BST1/CD157, low conductance chloride channel, and the antigen recognized by TNT antibody.

In some embodiments, the antigen specific domains of the CARs comprise scFv sequences whose SEQ ID is set forth in Table 3.

In exemplary embodiments, the antigens that may be targeted for the therapeutic methods described herein include but are not limited to any one, two, three, four or more of the targets described in Table 3.

The disclosure also provides a method comprising administering a CAR (e.g., CAR I, CAR II, SIR, zSIR, Ab-TCR, TFP and the like) molecule, a cell expressing a CAR (e.g., CAR I, CAR II, SIR, zSIR, Ab-TCR, TFP and the like) molecule or a cell comprising a nucleic acid encoding a CAR (e.g., CAR I, CAR II, SIR, zSIR, Ab-TCR, TFP and the like) molecule to a subject. In one embodiment, the subject has a disorder described herein, e.g., the subject has cancer, infectious disease, allergic disease, degenerative disease or autoimmune disease, which expresses a target antigen described herein. In yet one embodiment, the subject has increased risk of a disorder described herein, e.g., the subject has increased risk of cancer, infectious disease, allergic disease, degenerative disease or autoimmune disease, which expresses a target antigen described herein. In one embodiment, the subject is a human. In another embodiment, the subject is an animal. In yet another embodiment, the subject is a companion animal such as a dog.

The disclosure provides methods for treating or preventing a disease associated with expression of a disease-associated antigen described herein.

In one embodiment, the disclosure provides methods of treating or preventing a disease by providing to the subject in need thereof immune effector cells (e.g., T cells) or stem cells that can give rise to immune effector cells that are engineered to express an X-CAR, wherein X represents a disease associated antigen as described herein, and wherein the disease causing or disease-associated cells express said X antigen. Table 11 provides a list of different antigens and the exemplary diseases that can be prevented, inhibited or treated using immune effector cells expressing CARs (e.g., CAR I, CAR II, SIR, zSIR, Ab-TCR, TFP and the like) targeting these antigens.

In one embodiment, the disclosure provides methods of treating cancer, autoimmune or allergic disease by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to different antigens shown in Table 3 wherein the ASD of CARs is comprised of vL and vH fragments whose SEQ ID Nos are listed in Table 3.

In one embodiment, the disclosure provides methods of treating cancer, autoimmune or allergic disease by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60)(See, e.g., Table 2) specific to CD19, wherein the disease causing or disease associated cells express CD19 and wherein the ASD of CD19-CAR is comprised of vL and vH fragments whose SEQ ID NOs are listed in Table 3. In one embodiment, the cancer to be treated is acute lymphoblastic leukemia, chronic lymphocytic leukemia, B cell malignancy, non-Hodgkins lymphoma, diffuse large B-cell lymphoma, mantle cell lymphoma, or, multiple myeloma. In one embodiment, the disease to be treated is an immune (e.g., lupus, SLE, ITP etc.) or allergy disease.

In one embodiment, the disclosure provides methods of treating cancer, autoimmune or allergic disease by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to CD20, wherein the disease causing or disease associated cells express CD20 and wherein the ASD of CD20-CAR is comprised of vL and vH fragments whose SEQ ID NOs are listed in Table 3. In one embodiment, the cancer to be treated is acute lymphoblastic leukemia, chronic lymphocytic leukemia, B cell malignancy, non-Hodgkins lymphoma, diffuse large B-cell lymphoma, or mantle cell lymphoma. In one embodiment, the disease to be treated is an immune (e.g., lupus, SLE, ITP etc.) or allergy disease.

In one embodiment, the disclosure provides methods of treating cancer, autoimmune or allergic disease by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to CD22, wherein the disease causing or disease associated cells express CD22 and wherein the ASD of CD22-CAR is comprised of vL and vH fragments whose SEQ ID NOs are listed in Table 3. In one embodiment, the cancer to be treated is acute lymphoblastic leukemia, chronic lymphocytic leukemia, B cell malignancy, non-Hodgkins lymphoma, diffuse large B-cell lymphoma, or mantle cell lymphoma. In one embodiment, the disease to be treated is an immune (e.g., lupus, SLE. ITP etc.) or allergy disease.

In one embodiment, the disclosure provides methods of treating cancer, autoimmune or allergic disease by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to BCMA, wherein the disease causing or disease associated cells express BCMA and wherein the ASD of BCMA-CAR is comprised of vL and vH fragments whose SEQ ID NOs are listed in Table 3. In one embodiment, the disease to be treated or prevented is a cancer or immune or allergic disease. In one embodiment, the cancer to be treated or prevented is a plasma cell malignancy or multiple myeloma or primary effusion lymphoma or diffuse large cell lymphoma. In one embodiment, the disease to be treated is an immune (e.g., lupus, SLE, ITP etc.) or allergy disease.

In one embodiment, the disclosure provides methods of treating cancer, autoimmune or allergic disease by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to MPL, wherein the disease causing or disease associated cells express MPL and wherein the ASD of MPL-CAR is comprised of vL and vH fragments whose SEQ ID NOs are listed in Table 3. In one embodiment, the cancer to be treated is acute myeloid leukemia, chronic myeloid leukemia, myelodysplastic syndrome.

In one embodiment, the disclosure provides methods of treating cancer, autoimmune or allergic disease by providing to the subject in need thereof immune effector cells (e.g., T cells, NKT cells) that are engineered to express CARs 1 to 15 (see, e.g., Table 1) or backbones (for example, backbone- 1, backbone-2, backbone-32 or backbone-60) (see, e.g., Table 2) specific to BAFF-R, wherein the disease causing or disease associated cells express BAFF-R and wherein the ASD of BAFF-R-CAR is comprised of vL and vH fragments whose SEQ ID NOs are listed in Table 3. In one embodiment, the cancer to be treated is chronic lymphocytic leukemia, mantle cell lymphoma, B cell lymphoma and acute leukemia.

In one embodiment, the disclosure provides methods of treating cancer, autoimmune or allergic disease by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to IL13Ra2, wherein the disease causing or disease associated cells express IL13Ra2 and wherein the ASD of IL13Ra2-CAR is comprised of vL and vH fragments whose SEQ ID NOs are listed in Table 3. In one embodiment, the cancer to be treated is a brain tumor.

In one embodiment, the disclosure provides methods of treating cancer, autoimmune or allergic disease by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to CD79b, wherein the disease causing or disease associated cells express CD79b and wherein the ASD of CD79b-CAR is comprised of vL and vH fragments whose SEQ ID NOs are listed in Table 3. In one embodiment, the cancer to be treated is acute lymphoblastic leukemia, chronic lymphocytic leukemia, chronic myeloid leukemia, diffuse large B-cell lymphoma, mantle cell lymphoma, myelodysplastic syndrome or multiple myeloma. In one embodiment, the disease to be treated is an immune (e.g., lupus, SLE, ITP etc.) or allergy disease.

In one embodiment, the disclosure provides methods of treating cancer, autoimmune or allergic disease by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to Her2, wherein the disease causing or disease associated cells express Her2 and wherein the ASD of Her2-CAR is comprised of vL and vH fragments whose SEQ ID NOs are listed in Table 3. In one embodiment, the cancer to be treated is beast cancer or gastric cancer.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to Mesothelin (MSLN), wherein the disease causing or disease associated cells express MSLN and wherein the ASD of MSLN-CAR is comprised of vL and vH fragments whose SEQ ID NOs are listed in Table 3. In one embodiment, the cancer to be treated is mesothelioma, lung cancer, pancreatic cancer, gastro-intestinal cancer, or ovarian cancer.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to TSHR, wherein the disease causing or disease associated cells express TSHR and wherein the ASD of TSHR-CAR is comprised of vL and vH fragments whose SEQ ID NOs are listed in Table 3. In one embodiment, the cancer to be treated is thyroid cancer or T cell leukemia/lymphoma.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to Prolactin Receptor (PRLR), wherein the disease causing or disease associated cells express PRLR and wherein the ASD of PRLR-CAR is comprised of vL and vH fragments whose SEQ ID NOs are listed in Table 3. In one embodiment, the cancer to be treated is breast cancer or chromophobe renal cell carcinoma.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to Folate Receptor 1 (FOLR1), wherein the disease causing or disease associated cells express FOLR1 and wherein the ASD of FOLR1-CAR is comprised of vL and vH fragments whose SEQ ID NOs are listed in Table 3. In one embodiment, the cancer to be treated is ovarian cancer, lung cancer, endometrial cancer or other solid tumors.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to PTK7, wherein the disease causing or disease associated cells express PTK7 and wherein the ASD of PTK7-CAR is comprised of vL and vH fragments whose SEQ ID NOs are listed in Table 3. In one embodiment, the disease to be treated or prevented is a cancer. In one embodiment, the cancer to be treated or prevented is melanoma, lung cancer or ovarian cancer.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to DLL3, wherein the disease causing or disease associated cells express DLL3 and wherein the ASD of DLL3-CAR is comprised of vL and vH fragments whose SEQ ID NOs are listed in Table 3. In one embodiment, the disease to be treated or prevented is a cancer. In one embodiment, the cancer to be treated or prevented is melanoma, lung cancer or ovarian cancer.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to EGFRviii, wherein the disease causing or disease associated cells express EGFRviii and wherein the ASD of EGFRviii-CAR is comprised of vL and H fragments whose SEQ ID NOs are listed in Table 3. In one embodiment, the disease to be treated or prevented is a cancer. In one embodiment, the cancer to be treated or prevented is brain cancer or lung cancer or other solid tumors.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to PSMA, wherein the disease causing or disease associated cells express PSMA and wherein the ASD of PSMA-CAR is comprised of vL and vH fragments whose SEQ ID NOs are listed in Table 3. In one embodiment, the disease to be treated or prevented is a cancer. In one embodiment, the cancer to be treated or prevented is prostate cancer.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to UPK1B, wherein the disease causing or disease associated cells express UPK1B and wherein the ASD of UPK1B-CAR is comprised of vL and vH fragments whose SEQ ID NOs are listed in Table 3. In one embodiment, the disease to be treated or prevented is a cancer. In one embodiment, the cancer to be treated or prevented is bladder cancer.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to WISP1, wherein the disease causing or disease associated cells express WISP1. In one embodiment the ASD of WISP1-CAR is comprised of vL and vH fragments whose SEQ ID NOs are listed in Table 3. In one embodiment, the disease to be treated or prevented is a cancer. In one embodiment, the cancer to be treated or prevented is glioblastoma or breast cancer.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to MMP16, wherein the disease causing or disease associated cells express MMP16. In one embodiment, the ASD of MMP16-CAR is comprised of vL and vH fragments whose SEQ ID NOs are listed in Table 3. In one embodiment, the disease to be treated or prevented is a cancer. In one embodiment, the cancer to be treated or prevented is glioblasatoma, melanoma, small cell lung cancer or neuroblastoma.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to BMPR1B, wherein the disease causing or disease associated cells express BMPR1B. In one embodiment, the ASD of BMPR1B-CAR is comprised of vL and vH fragments whose SEQ ID NOs are listed in Table 3. In one embodiment, the disease to be treated or prevented is a cancer. In one embodiment, the cancer to be treated or prevented is prostate cancer, breast cancer or ovarian cancer.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to SLC34A2, wherein the disease causing or disease associated cells express SLC34A2. In one embodiment, ASD of SLC34A2-CAR is comprised of vL and vH fragments whose SEQ ID NOs are listed in Table 3. In one embodiment, the disease to be treated or prevented is a cancer. In one embodiment, the cancer to be treated or prevented is lung cancer, ovarian cancer or endometrial cancer.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to gpA33, wherein the disease causing or disease associated cells express gpA33 and wherein the ASD of gpA33-CAR is comprised of vL and vH fragments whose SEQ ID NOs are listed in Table 3. In one embodiment, the disease to be treated or prevented is a cancer. In one embodiment, the cancer to be treated or prevented is colorectal cancer, ovarian cancer or endometrial cancer.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to BST1, wherein the disease causing or disease associated cells express BST1 and wherein the ASD of BST1-CAR is comprised of vL and vH fragments whose SEQ ID NOs are listed in Table 3. In one embodiment, the disease to be treated or prevented is a cancer. In one embodiment, the cancer to be treated or prevented is blood cancer.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to CD133, wherein the disease causing or disease associated cells express CD133 and wherein the ASD of CD133-CAR is comprised of vL and vH fragments whose SEQ ID NOs are listed in Table 3. In one embodiment, the disease to be treated or prevented is a cancer. In one embodiment, the cancer to be treated or prevented is lung cancer or brain cancer.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to EMR2, wherein the disease causing or disease associated cells express EMR2 and wherein the ASD of EMR2-CAR is comprised of vL and vH fragments whose SEQ ID NOs are listed in Table 3. In one embodiment, the disease to be treated or prevented is a cancer. In one embodiment, the cancer to be treated or prevented is acute leukemia, lymphoma, breast cancer and colon cancer.

In one embodiment, the disclosure provides methods of treating cancer by providing to the subject in need thereof immune effector cells (e.g. T cells, NKT cells) that are engineered to express CARs 1 to 15 (see, e.g., Table 1) or backbones (for example, backbone-1, backbone-2, backbone-32 or backbone-60) (see, e.g., Table 2) specific to GPC3, wherein the disease causing or disease associated cells express GPC3 and wherein the ASD of GPC3-CAR is comprised of vL and vH fragments whose SEQ ID NOs are listed in Table 3. In one embodiment, the disease to be treated or prevented is a cancer. In one embodiment, the cancer to be treated or prevented is liver cancer, breast cancer and lung cancer.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to gpNMB, wherein the disease causing or disease associated cells express gpNMB and wherein the ASD of gpNMB-CAR is comprised of vL and vH fragments whose SEQ ID NOs are listed in Table 3. In one embodiment, the disease to be treated or prevented is a cancer. In one embodiment, the cancer to be treated or prevented is melanoma, brain cancer, breast cancer, lung cancer and other solid tumors.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to IL1RAP, wherein the disease causing or disease associated cells express IL1RAP and wherein the ASD of IL1RAP-CAR is comprised of vL and vH fragments whose SEQ ID NOs are listed in Table 3. In one embodiment, the disease to be treated or prevented is a cancer or endometrioses. In one embodiment, the cancer to be treated or prevented is liver cancer, cervical cancer, colon cancer, ovarian cancer and other solid tumors.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to Nectin-4, wherein the disease causing or disease associated cells express Nectin-4 and wherein the ASD of Nectin-4-CAR is comprised of vL and vH fragments whose SEQ ID NOs are listed in Table 3. In one embodiment, the disease to be treated or prevented is a cancer or endometriosis. In one embodiment, the cancer to be treated or prevented is bladder cancer, renal cancer, head and neck cancer, ovarian cancer, breast cancer, lung cancer and other solid tumors.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to Cripto, wherein the disease causing or disease associated cells express Cripto and wherein the ASD of Cripto-CAR is comprised of vL and vH fragments whose SEQ ID NOs are listed in Table 3. In one embodiment, the disease to be treated or prevented is a cancer. In one embodiment, the cancer to be treated or prevented is, colorectal cancer, ovarian cancer, endometrial cancer and other solid tumors.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to RNF43, wherein the disease causing or disease associated cells express RNF43 and wherein the ASD of RNF43-CAR is comprised of vL and vH fragments whose SEQ ID NOs are listed in Table 3. In one embodiment, the disease to be treated or prevented is a cancer. In one embodiment, the cancer to be treated or prevented is, colorectal cancer, breast cancer, endometrial cancer and other solid tumors.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to ROR1, wherein the disease causing or disease associated cells express ROR1 and wherein the ASD of ROR1-CAR is comprised of vL and vH fragments whose SEQ ID NOs are listed in Table 3. In one embodiment, the disease to be treated or prevented is a cancer. In one embodiment, the cancer to be treated or prevented is, blood cancer, CLL and lymphoma.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to FLT3, wherein the disease causing or disease associated cells express FLT3 and wherein the ASD of FLT3-CAR is comprised of vL and vH fragments whose SEQ ID NOs are listed in Table 3. In one embodiment, the disease to be treated or prevented is a cancer. In one embodiment, the cancer to be treated or prevented is blood cancer.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to CLL-1, wherein the disease causing or disease associated cells express CLL-1 and wherein the ASD of CLL-1-CAR is comprised of vL and vH fragments whose SEQ ID NOs are listed in Table 3. In one embodiment, the disease to be treated or prevented is a cancer. In one embodiment, the cancer to be treated or prevented is blood cancer.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g, Table 2) specific to Robo4, wherein the disease causing or disease associated cells express Robo4. In one embodiment, the ASD of Robo4-CAR is comprised of vL and vH fragments whose SEQ ID NOs are listed in Table 3. In one embodiment, the disease to be treated or prevented is a cancer. In one embodiment, the cancer to be treated or prevented is renal cancer, colon cancer, breast cancer or other solid tumor.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to CLDN6, wherein the disease causing or disease associated cells express CLDN6. In one embodiment, the ASD of CLDN6-CAR is comprised of vL and vH fragments whose SEQ ID NOs are listed in Table 3. In one embodiment, the disease to be treated or prevented is a cancer. In one embodiment, the cancer to be treated or prevented is ovarian cancer, liver cancer or other solid tumor.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to Muc5Ac, wherein the disease causing or disease associated cells express Muc5Ac. In one embodiment, the ASD of Muc5Ac-CAR is comprised of vL and vH fragments whose SEQ ID NOs are listed in Table 3. In one embodiment, the disease to be treated or prevented is a cancer. In one embodiment, the cancer to be treated or prevented is pancreatic cancer, stomach cancer, colon cancer or other solid tumor.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to Muc17, wherein the disease causing or disease associated cells express Muc17. In one embodiment, the ASD of Muc17-CAR is comprised of vL and vH fragments whose SEQ ID NOs are listed in Table 3. In one embodiment, the disease to be treated or prevented is a cancer. In one embodiment, the cancer to be treated or prevented is pancreatic cancer, stomach cancer, colon cancer or other solid tumor.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to Ly6E, wherein the disease causing or disease associated cells express Ly6E. In one embodiment, the ASD of Ly6E-CAR is comprised of vL and vH fragments whose SEQ ID NOs are listed in Table 3. In one embodiment, the disease to be treated or prevented is a cancer. In one embodiment, the cancer to be treated or prevented is pancreatic cancer, breast cancer, ovarian cancer, pancreatic cancer or other solid tumor.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to Integrin B7, wherein the disease causing or disease associated cells express Integrin B7. In one embodiment, the ASD of Integrin B7-CAR is comprised of vL and vH fragments whose SEQ ID NOs are listed in Table 3. In one embodiment, the disease to be treated or prevented is a cancer. In one embodiment, the cancer to be treated or prevented is plasma cell neoplasm or primary effusion lymphoma.

In one embodiment, the disclosure provides methods of treating cancer by providing to the subject in need thereof immune effector cells (e.g., T cells, NKT cells) that are engineered to express CARs 1 to 15 (see, e.g., Table 1) or backbones (for example, backbone-1, backbone-2, backbone-32 or backbone-60) (see, e.g., Table 2) specific to STEAP1, wherein the disease causing or disease associated cells express STEAP1. In one embodiment, the ASD of STEAP1-CAR is comprised of vL and vH fragments whose SEQ ID NOs are listed in Table 3. In one embodiment, the disease to be treated or prevented is a cancer. In one embodiment, the cancer to be treated or prevented gastric cancer, prostate cancer or lymphoma.

In one embodiment, the disclosure provides methods of treating cancer by providing to the subject in need thereof immune effector cells (e.g. T cells, NKT cells) that are engineered to express CARs 1 to 15 (see, e.g., Table 1) or backbones (for example, backbone-1, backbone-2, backbone-32 or backbone-60) (see, e.g., Table 2) specific to Liv1, wherein the disease causing or disease associated cells express Liv1. In one embodiment, the ASD of Liv1-CAR is comprised of vL and vH fragments whose SEQ ID NOs are listed in Table 3. In one embodiment, the disease to be treated or prevented is a cancer. In one embodiment, the cancer to be treated or prevented breast cancer, prostate cancer or solid tumor.

Exemplary cancers whose growth can be inhibited include cancers typically responsive to immunotherapy. Non-limiting examples of cancers for treatment include melanoma (e.g., metastatic malignant melanoma), renal cancer (e.g clear cell carcinoma), prostate cancer (e.g. hormone refractory prostate adenocarcinoma), breast cancer, colon cancer and lung cancer (e.g. non-small cell lung cancer). Additionally, refractory or recurrent malignancies can be treated using the molecules described herein. Finally, non-malignant diseases, such as endometriosis, can be treated using the CARs (e.g. CAR I, CAR II, SIR, zSIR, Ab-TCR, TFP and the like) described herein.

In exemplary embodiments, cancers treated by the methods described herein include solid tumors such as sarcomas, adenocarcinomas, and carcinomas, of the various organ systems, such as those affecting liver, lung, breast, lymphoid, gastrointestinal (e.g., colon), genitourinary tract (e.g., renal, urothelial cells), prostate and pharynx. Adenocarcinomas include malignancies such as most colon cancers, rectal cancer, renal-cell carcinoma, liver cancer, non-small cell carcinoma of the lung, cancer of the small intestine and cancer of the esophagus. In one embodiment, the cancer is a melanoma, e.g., an advanced stage melanoma. Metastatic lesions of the aforementioned cancers can also be treated or prevented using the methods and compositions of the disclosure.

Examples of other cancers that can be treated include bone cancer, pancreatic cancer, skin cancer, cancer of the head or neck, cutaneous or intraocular malignant melanoma, uterine cancer, ovarian cancer, rectal cancer, cancer of the anal region, stomach cancer, testicular cancer, uterine cancer, carcinoma of the fallopian tubes, carcinoma of the endometrium, carcinoma of the cervix, carcinoma of the vagina, carcinoma of the vulva, Hodgkin Disease, non-Hodgkin lymphoma, cancer of the esophagus, cancer of the small intestine, cancer of the endocrine system, cancer of the thyroid gland, cancer of the parathyroid gland, cancer of the adrenal gland, sarcoma of soft tissue, cancer of the urethra, cancer of the penis, chronic or acute leukemias including acute myeloid leukemia, chronic myeloid leukemia, acute lymphoblastic leukemia, chronic lymphocytic leukemia, solid tumors of childhood, lymphocytic lymphoma, cancer of the bladder, cancer of the kidney or ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers including those induced by asbestos, and combinations of said cancers. Treatment of metastatic cancers, e.g., metastatic cancers that express PD-L 1 (Iwai et al. (2005) Int. Immunol. 17:133-

144) can be effected using the CAR molecules described herein. Further a disease associated with a cancer associate antigen as described herein expression include, but not limited to, e.g., atypical and/or non-classical cancers, malignancies, precancerous conditions or proliferative diseases associated with expression of a cancer associate antigen as described herein. Finally, non-malignant diseases, such as endometriosis, can be treated using the CARs described herein. In some embodiments, a CAR-expressing T cell or NKT cell as described herein reduces the quantity, number, amount or percentage of cells and/or cancer cells by at least 25%, at least 30%, at least 40%, at least 50%, at least 65%, at least 75%, at least 85%, at least 95%, or at least 99% in a subject with hematological cancer or another cancer associated with a cancer associated antigen as described herein, expressing cells relative to a negative control. In one embodiment, the subject is a human.

In one aspect, the disclosure pertains to a method of inhibiting growth of a disease (e.g., cancer, autoimmune disease, infectious disease or allergic disease or a degenerative disease), comprising contacting the disease causing or disease associated cell with a genetically modified cell of the disclosure expressing a CAR (e.g., CAR I, CAR II, SIR, zSIR, Ab-TCR, TFP and the like) or a CAR with accessory modules (i.e., backbones 1-60; see Table 2) such that the CAR-T is activated in response to the antigen and targets the disease causing or disease associated cell, wherein the growth of the disease causing or disease associated cell is inhibited. In one aspect, the disclosure pertains to a method of preventing a disease, comprising administering to a patient at risk of disease a CAR- or next generation CAR—(e.g., SIR, zSIR, Ab-TCR, TFP and the like) expressing cell or a cell that is capable of generating a CAR-expressing cell of the disclosure such that the CAR-T is activated in response to the antigen and targets the disease causing or disease associated cell, wherein the growth of the disease causing or disease associated cell is prevented. In one aspect the disease is a cancer, an infectious disease, an immune disease, an allergic disease, or a degenerative disease.

In one aspect, the disease is an autoimmune disease. In one embodiment, the autoimmune disease is selected from the group consisting of Acquired Immunodeficiency Syndrome (AIDS), alopecia areata, ankylosing spondylitis, antiphospholipid syndrome, autoimmune Addison's disease, autoimmune hemolytic anemia, autoimmune hepatitis, autoimmune inner ear disease (AIED), autoimmune lymphoproliferative syndrome (ALPS), autoimmune thrombocytopenic purpura (ATP), Behcet's disease, cardiomyopathy, celiac sprue-dermatitis hepetiformis; chronic fatigue immune dysfunction syndrome (CFIDS), chronic inflammatory demyelinating polyneuropathy (CIPD), cicatricial pemphigoid, cold agglutinin disease, crest syndrome, Crohn's disease, Degos' disease, dermatomyositis-juvenile, discoid lupus, essential mixed cryoglobulinemic, fibromyalgia-fibromyositis. Graves' disease, Guillain-Barre syndrome, Hashimoto's thyroiditis, idiopathic pulmonary fibrosis, idiopathic thrombocytopenia u ura (Γ P), IgA nephropathy, insulin-dependent diabetes mellitus, juvenile chronic arthritis (Still's disease), juvenile rheumatoid arthritis, Meniere's disease, mixed connective tissue disease, multiple sclerosis, myasthenia gravis, pernacious anemia, polyarteritis nodosa, polychondritis, polyglandular syndromes, polymyalgia rheumatica, polymyositis and dermatomvositis, primary agammaglobulinemia, primary biliary cirrhosis, psoriasis, psoriatic arthritis, Raynaud's phenomena, Reiter's syndrome, rheumatic fever, rheumatoid arthritis, sarcoidosis, scleroderma (progressive systemic sclerosis (PSS), also known as systemic sclerosis (SS)), Sjogren's syndrome, stiff-man syndrome, systemic lupus erythematosus (SLE), Takayasu arteritis, temporal arteritis/giant cell arteritis, ulcerative colitis, uveitis, vitiligo, Wegener's granulomatosis, and any combination thereof.

Embodiments of the disclosure include a type of cellular therapy where effector cells (such as T cells and NK cells) or stem cells that can give rise to effector cells are genetically modified to express a CAR as described herein and the CAR- or next generation CAR—(e.g., SIR, zSIR, Ab-TCR, TFP and the like)-expressing T cell or NKT cell is infused to a recipient in need thereof. The infused cell is able to kill tumor cells in the recipient. In various aspects, the immune effector cells (e.g. T cells, NKT cells) administered to the patient, or their progeny, persist in the patient for at least four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty-three months, two years, three years, four years, or five years after administration of the T cell or NK cell to the patient.

The disclosure also includes a type of cellular therapy where immune effector cells (e.g., T cells, NK cells) are modified, e.g., by in vitro transcribed RNA, to transiently express a CAR (e.g., CAR I, CAR II, SIR, zSIR, Ab-TCR, TFP and the like) or a CAR with accessory modules (e.g., backbones 1-60). T cells or NKT cells are infused to a recipient in need thereof. The infused cells are able to kill disease associated cells (e.g., tumor cells or virally infected cells) in the recipient. Thus, in various aspects, the CAR- or next generation CAR-expressing immune effector cells (e.g., I cells, NKT cells) persist for less than one month, e.g., three weeks, two weeks, one week, after administration of the T cell or NK cell to the patient.

The disclosure also includes a type of cellular therapy where stem cells (e.g., hematopoietic stein cell or lymphoid stein cells or embryonic stem cells, or induced pluripotent stem cells) that are capable of giving rise to immune effector cells (e.g., T cells or NK cells) are modified to express a CAR (e.g., CAR I, CAR II, SIR, zSIR, Ab-TCR, TFP and the like) or a CAR (e.g., CAR I, CAR II, SIR, zSIR, Ab-TCR, TFP and the like) with accessory modules (e.g., backbones 1-60: see Table 2) and are administered to a recipient in need thereof. The administered stem cells give rise to immune effector cells T cells or NKT cells) after transplantation into the recipient, which (i.e. the immune effector cells) are able to kill disease associated cells in the recipient. Thus, in various aspects, the immune effector cells (e.g., T cells, NKT cells) that are produced in the patient after administration of CAR- or next generation CAR-expressing stem cells persist in the patient for at least one week, 2 weeks, 3 weeks, one month, two months, three months, four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty three months, two years, three years, four years, five years, ten years or twenty years after administration of the genetically modified stem cells to the patient. The disclosure also includes a type of cellular therapy where stem cells that are capable of giving rise to immune effector cells (e.g., T cells or NKT cells) are modified to express a CAR (e.g., CAR I, CAR II, SIR zSIR, Ab-TCR, TFP and the like) or a CAR with accessory modules (e.g. backbones 1-60; see Table 2)

and are differentiated in vitro to generate immune effector cells that are infused to a recipient in need thereof. The infused immune effector cells (e.g., T cells or NKT cells) after infusion into the recipient are able to kill disease associated cells in the recipient. Thus, in various aspects, the immune effector cells (e.g., T cells, NK cells) that are administered to the patient persist in the patient for at least 1 day, 2 days, 3 days, 4 days. 5 days, 6 days, one week, 2 weeks, 3 weeks, one month, two months, three months, four months, five months, six months, seven months, eight months, nine months, ten months, eleven months, twelve months, thirteen months, fourteen month, fifteen months, sixteen months, seventeen months, eighteen months, nineteen months, twenty months, twenty-one months, twenty-two months, twenty three months, two years, three years, four years, five years, ten years or twenty years.

The disclosure also includes a type of cellular therapy where regulatory immune effector cells (e.g., TREG, or CD25+ T Cells) are modified to express a CAR (e.g., CAR I, CAR II, SIR, zSIR, Ab-TCR, TFP and the like) or a CAR with accessory modules (e.g., backbones 1-60) targeting a specific antigen. Such CAR-TREG are administered to a patient to suppress immune response against the specific antigen. The CAR-TREG can be used to prevent and treat autoimmune diseases and to enhance immune tolerance.

The anti-tumor immunity response elicited by the CAR- or next generation CAR-modified immune effector cells (e.g., T cells. NKT cells) may be an active or a passive immune response, or alternatively may be due to a direct vs indirect immune response. In one aspect, the CAR- or next generation CAR-transduced immune effector cells (e.g T cells, NK cells) exhibit specific pro-inflammatory cytokine secretion and potent cytolytic activity in response to human diseased cells (e.g., cancer or infected cells) expressing the disease associate antigen as described herein, resist soluble disease associate antigen as described herein, mediate bystander killing and mediate regression of an established human disease, including cancer.

The disclosure also includes a type of cellular therapy where immune effector cells (e.g., T cells and NKT cells) or stem cells that are capable of giving rise to immune effector cells (e.g., T cells or NK cells) are modified to express a CAR. (e.g., CAR. I, CAR II, SIR, zSIR, Ab-TCR, TFP and the like) or a CAR with accessory modules (e.g., backbones 1-60) and are used ex vivo to purge the bone marrow or peripheral blood hematopoietic stein cells of disease-associated cells (e.g. cancer cells). As an example, T cells expressing a CD19-specific CAR (e.g., CAR I, CAR II, SIR, zSIR, Ab-TCR, TFP and the like) are cocultured with bone marrow or peripheral blood stem cell sample taken from a patient with acute lymphocytic leukemia or non-Hodgkin lymphoma so as to kill off any leukemia or lymphoma cells present in the bone marrow or peripheral blood stem cell preparation. After a suitable duration of culture in vitro x vivo), which may range from a 6 hours to several days, the purged bone marrow and peripheral blood sample is used for autologous transplant in the patient.

Ex vivo expansion of hematopoietic stem and progenitor cells has been described in U.S. Pat. No. 5,199,942, and is incorporated herein by reference, and can be applied to the cells of the disclosure. However, the disclosure is not limited to any particular method of ex vivo expansion of the cells and other suitable methods known in the art can be utilized. Briefly, ex vivo culture and expansion of hematopoietic stem cells comprises: (1) collecting CD34+ hematopoietic stem and progenitor cells from a mammal from peripheral blood harvest or bone marrow explants; and (2) expanding such cells ex vivo. In addition to the cellular growth factors described in U.S. Pat. No. 5,199,942, other factors such as flt3-L. IL-3 and c-kit ligand, can be used for culturing and expansion of the cells.

In addition to using a cell-based vaccine in terms of ex vivo immunization, the disclosure also provides compositions and methods for in vivo immunization to elicit an immune response directed against an antigen in a patient.

In some embodiments, the fully-human CAR- or next generation CAR-modified genetically modified cells (such as T cells. NKT cells) of the disclosure may be a type of vaccine for ex vivo immunization and/or in vivo therapy in a mammal (for example, human). With respect to ex vivo immunization, at least one of the following occurs in vitro prior to administering the cell into a mammal: i) expansion of the cells, ii) introducing a nucleic acid encoding a CAR to the cells or iii) cryopreservation of the cells. Ely vivo procedures are well known in the art, for example, as described in U.S. Pat. No. 5,199,942, incorporated herein by reference.

In addition to using a cell-based vaccine in terms of ex vivo immunization, the disclosure also provides compositions and methods for in vivo immunization to elicit an immune response directed against an antigen in a patient.

Further described herein are methods for controlling the activity of CAR-T cells when administered to the patients. In some embodiment these methods can be used to control the side effects of CAR-T cells, such as cytokine release syndrome, capillary leak syndrome and neurological complications. In some embodiment the method involves administration of inhibitors of tyrosine kinases, particularly Scr family kinase, and in particular Lck kinase. In one embodiment, the method involves administration of Dasatinib, an oral small molecule inhibitor of Abl and Src family tyrosine kinases (SFK), including p56Lck (Lck) (Lee K C et al, Leukemia (2010) 24, 896-900). In one embodiment, the Src kinase inhibitor is administered to the patient after the administration of CAR-expressing cells to control or terminate the activity of CAR-expressing cells. In one embodiment, an Lck inhibitor is administered to the patient after the administration of CAR-expressing cells to control or terminate the activity of CAR-expressing cells. In one embodiment, Lck inhibitor is A-770041.

In one embodiment, Dasatinib is administered to the patient after the administration of CAR-expressing cells to control or terminate the activity of CAR-expressing cells. In one embodiment, dasatinib is administered orally at a dose of at least 10 mg/day, 20 mg/day, 40 mg/day, 60 mg/day, 70 mg/day, 90 mg/day, 100 mg/day, 140 mg/day, 180 mg/day, 210 mg/day, 250 mg/day or 280 mg/day.

In one embodiment, Ponatinib is administered to the patient after the administration of CAR-expressing cells to control or terminate the activity of CAR-expressing cells. In one embodiment, ponatinib is administered orally at a dose of at least 15 mg/day, 30 mg/day, 45 mg/day, 60 mg/day.

T lymphocytes have a limited replicative life span until they reach the terminally differentiated state and then enter into a replicative senescence phase due to progressive loss of telomeres with age. Human T lymphocytes display a limited life-span of about 30-50 population doublings when cultured in vitro.

Further contemplated herein are methods for promoting the survival and proliferation of peripheral blood mononuclear cells and T cells and preventing their replicative senescence to extend the life span of immune cells (e.g., lymphocytes and NK cells) for the purpose of adoptive cell therapy. The method entails ectopic expression of viral and/or cellular proteins that promote survival and proliferation and block activation induced cell death. An exemplary protein suitable for this purpose includes viral FLICE Inhibitory Protein (vFLIP) K13 encoded by the Kaposi's sarcoma associated herpesvirus (also known as human herpesvirus 8). In some embodiments, the above viral and cellular proteins are expressed in the immune cells (e.g., T cells and NK cells) in their native state or carrying small epitope tags and are functionally active in a constitutive manner. In other embodiments, the above viral and cellular proteins are expressed in the immune cells (e.g., T cells and NK cells) in fusion with one or more copies of a switch domain (or a dimerization domain), such as FKBP and FKBPx2. In other embodiment, the FKBP or the FKBP-x2 domain may additionally carry an N-terminal myrisotylation (Myr) sequence to anchor the fusion proteins to the cell membrane. The fusion proteins carrying the switch domains are functionally inactive in their basal state but are activated upon addition of a dimerizer agent, such as AP20187 as described in PCT/US2017/024843, which is incorporated by reference in its entirety herein.

Further contemplated herein are methods for promoting lentiviral mediated transduction and/or expression of a foreign gene and/or cDNA. The method involves expression of HIV1-Vif protein. In some embodiment, the Vif protein is encoded on the same vector as the foreign gene and/or cDNA. In some embodiment, the Vif protein is encoded on a different vector as the foreign gene/cDNA. Exemplary foreign gene/cDNA whose transfer and/or expression can be enhanced by coexpression of HIV1 Vif protein include CAR (e.g., CAR I, CAR II, SIR, zSIR, Ab-TCR), recombinant TCR, globin, and adenosine deaminase etc. In some embodiment, co-expression of HIV1 Vif protein can be used to promote the lentiviral mediated transduction and/or expression of any encoded gene/cDNA or nucleic acid fragment. In some embodiment, the HIV1 Vif protein is encoded on the same vector as the gene/cDNA of interest. An exemplary vector encoding a CAR and coexpressing HIV1 Vif protein is presented in SEQ ID NO: 11268. Exemplary nucleic acid cassettes encoding CARs and HIV Vif are presented in SEQ ID NOs: 11244-11267. In some embodiment, the HIV1 Vif protein is encoded on a different vector as the gene/cDNA of interest. The HIV1 Vif protein can be used to enhance gene transfer/expression in any mammalian cell. In some embodiments, the HIV1 Vif protein is used to enhance gene transfer/expression into peripheral blood mononuclear cells, T cells, NK cells, NKT cells, B cells, hematopoietic stem cells, induced pluripotent stem cells, liver cells, brain cells or skin cells.

In an embodiment, an immune effector cell, e.g., a T cell, ectopically expresses one or more of a viral or cellular signaling protein selected from the group of K13-vFLIP (SEQ ID NO: 4107), MC159 (SEQ ID NO:4108), cFLIP-L/MRIT-alpha (SEQ ID NO: 4109), cFLIP-p22 (SEQ ID NO: 4110), HIV1-Vif (SEQ ID NO: 4117), HTLV1-TAX (SEQ ID NO: 4113), HTLV2-TAX (SEQ ID NO: 4114), HTLV2-TAX-RS (SEQ ID NO: 4115) or a protein with 70-99% identity to amino acid sequences of the above proteins.

In an embodiment, an immune effector cell, e.g., a T cell, ectopically expresses a fusion protein containing one or more switch domains, e.g., FKBP, FKBPx2 or Myr-FKBP, and one or more viral or cellular signaling protein selected from the group K13-vFLIP (SEQ ID NO: 4107), MC159 (SEQ ID NO:4108), cFLIP-L/MRIT-alpha (SEQ ID NO: 4109), cFLIP-p22 (SEQ ID NO: 4110), HIV1-Vif (SEQ ID NO: 4117), HTLV1-TAX (SEQ ID NO: 4113), HTLV2-TAX (SEQ ID NO: 4114), HTLV2-TAX-RS (SEQ ID NO: 4115).

In some aspects, this disclosure provides a method of producing an immune effector cell suitable for adoptive cellular therapy, comprising contacting the cell with a nucleic acid encoding partially or completely one or more of a viral or cellular signaling protein selected from the group of K13-vFLIP (SEQ ID NO: 4107), MC159 (SEQ ID NO:4108), cFLIP-L/MRIT-alpha (SEQ ID NO: 4109), cFLIP-p22 (SEQ ID NO: 4110), HIV1-Vif (SEQ ID NO: 4117), HTLV1-TAX (SEQ ID NO: 4113), HTLV2-TAX (SEQ ID NO: 4114), HTLV2-TAX-RS (SEQ ID NO: 4115) or proteins with 70-99% identity to amino acid sequences of the above proteins.

In some aspects, this disclosure provides a method of producing an immune effector cell suitable for adoptive cellular therapy, comprising contacting the cell with a nucleic acid encoding a fusion protein containing one or more switch domains, e.g., FKBP, FKBPx2 or Myr-FKBP, and one or more viral or cellular signaling protein is selected from the group of K13-vFLIP (SEQ ID NO: 4107), MC159 (SEQ ID NO:4108), cFLIP-L/MRIT-alpha (SEQ ID NO: 4109), cFLIP-p22 (SEQ ID NO: 4110), HIV1-Vif (SEQ ID NO: 4117), HTLV1-TAX (SEQ ID NO: 4113), HTLV2-TAX (SEQ ID NO: 4114), HTLV2-TAX-RS (SEQ ID NO: 4115) or proteins with 70-99% identity to amino acid sequences of the above proteins.

In an embodiment, the cell suitable for adoptive cell therapy expresses a natural or synthetic immune receptor. Exemplary such immune receptors include a chimeric antigen receptor (CAR), a T cell receptor (TCR), a chimeric T cell receptor (cTCR), a synthetic T cell receptor, a TCR fusion protein (TFP), a Ab-TCR and a synthetic notch receptor. In an embodiment, the cell may be contacted with the nucleic acid encoding the viral and cellular signaling proteins before, simultaneous with, or after being contacted with a construct encoding a natural or synthetic immune receptor. In an embodiment, the cell may be contacted with the nucleic acid encoding the viral and cellular signaling proteins containing a switch or dimerization domain before, simultaneous with, or after being contacted with a construct encoding a natural or synthetic immune receptor.

In one aspect, the disclosure features a method of making a population of immune effector cells (e.g., T cells, NK cells). In an embodiment, the method comprises: providing a population of immune effector cells (e.g., T cells or NK cells), contacting the population of immune effector cells with a nucleic acid encoding an immune receptor (e.g., CAR, TCR, synthetic TCR) and contacting the population of immune effector cells with a nucleic acid encoding a viral or cellular signaling protein, under conditions that allow for immune receptor and viral or cellular signaling protein co-expression.

In an embodiment, the nucleic acid encoding the viral or cellular signaling protein is DNA. In an embodiment, the nucleic acid encoding the viral or cellular signaling protein contains promoter capable of driving expression of the viral and cellular signaling proteins. In an embodiment, the nucleic acid encoding the viral or cellular signaling protein and the nucleic acid encoding the immune receptor is expressed from the same vector. In an embodiment, the nucleic acid encoding the viral or cellular signaling protein and the nucleic acid encoding the immune receptor is expressed from separate vectors. In an embodiment, the nucleic acid encoding the viral or cellular signaling protein (subunit 1) and the nucleic acid encoding the immune receptor (subunit 2) is expressed from the same polynucleotide fragment containing an internal ribosomal entry site (IRES) that allows the translation of the second subunit. In an embodiment, the nucleic acid encoding the viral or cellular signaling protein (subunit 1) and the nucleic acid encoding the immune receptor (subunit 2) is expressed from a single polynucleotide fragment that encodes and the different subunits are separated by a cleavable linker.

In an embodiment, the nucleic acid encoding the viral or cellular signaling protein is an in vitro transcribed RNA. In an embodiment, the viral or cellular signaling protein (subunit 1) and the immune receptor (subunit 2) is expressed from the same RNA containing an internal ribosomal entry site (IRES) that allows the translation of the second subunit. In an embodiment, the viral or cellular signaling protein (subunit 1) and the immune receptor (subunit 2) are expressed from a single RNA and the different subunits are separated by cleavable linkers.

In an embodiment, the nucleic acid encoding the cellular signaling protein is the genomic copy of the said protein that is been activated by activation of its promoter by genetic or chemical means.

Therapeutic methods described herein comprise using compositions comprising genetically modified cells comprising nucleic acids encoding CARs (e.g., CAR I, CAR II, SIR, zSIR, Ab-TCR, TFP and the like) described herein. In various embodiments, the therapeutic methods described herein may be combined with existing therapies and agents. The therapeutic compositions described herein, comprising genetically modified cells comprising nucleic acids encoding the CARs (e.g., CAR I, CAR II, SIR, zSIR, Ab-TCR, TFP and the like) described herein, are administered to the subject with at least one additional known therapy or therapeutic agent. In some embodiments, the compositions described herein and the additional therapy or therapeutic agents are administered sequentially. In some embodiments, the compositions described herein and the additional therapy or therapeutic agents are administered simultaneously. The optimum order of administering the compositions described herein and the existing therapies will be apparent to a person of skill in the art, such as a physician.

A CAR or next generation CAR-expressing cell described herein and the at least one additional therapeutic agent can be administered simultaneously, in the same or in separate compositions, or sequentially. For sequential administration, the CAR-expressing cell described herein can be administered first, and the additional agent can be administered second, or the order of administration can be reversed.

Combinations therapies may be administered to the subject over the duration of the disease. Duration of the disease includes from diagnosis until conclusion of treatment, wherein the treatment results in reduction of symptoms and/or elimination of symptoms. In various embodiments, the effect of the two treatments can be partially additive, wholly additive, or greater than additive. The delivery can be such that an effect of the first treatment delivered is still detectable when the second is delivered.

The CAR (e.g., CAR I, CAR II, SIR, zSIR, Ab-TCR, TFP and the like) therapy and/or other therapeutic agents, procedures or modalities can be administered during periods of active disorder, or during a period of remission or less active disease. The CAR (e.g., CAR I, CAR II, SIR, zSIR, Ab-TCR, TFP and the like) therapy can be administered before the other treatment, concurrently with the treatment, post-treatment, or during remission of the disorder.

When administered in combination, the CAR (e.g., CAR I, CAR II, SIR, zSIR, Ab-TCR, TFP and the like) therapy and the additional agent (e.g., second or third agent), or all, can be administered in an amount or dose that is higher, lower or the same than the amount or dosage of each agent used individually, e.g., as a monotherapy. In certain embodiments, the administered amount or dosage of the CAR (e.g., CAR I, CAR II, SIR, zSIR, Ab-TCR, TFP and the like) therapy, the additional agent (e.g., second or third agent), or all, is lower (e.g., at least 20%, at least 30%, at least 40%, or at least 50%) than the amount or dosage of each agent used individually, e.g., as a monotherapy. In other embodiments, the amount or dosage of the CAR (e.g., CAR I, CAR II, SIR, zSIR, Ab-TCR, TFP and the like) therapy, the additional agent (e.g., second or third agent), or all, that results in a desired effect (e.g., treatment of cancer) is lower (e.g., at least 20%, at least 30%, at least 40%, or at least 50% lower) than the amount or dosage of each agent used individually, e.g., as a monotherapy, required to achieve the same therapeutic effect.

Further method aspects relate administering to the subject an effective amount of a cell, e.g., an immune effector cell, or a population thereof, each cell comprising a CAR (e.g., CAR I, CAR II, SIR, zSIR, Ab-TCR, TFP and the like) molecule, optionally in combination with an agent that increases the efficacy and/or safety of the immune cell. In further aspects, the agent that increases the efficacy and/or safety of the immune cell is one or more of: (i) a protein phosphatase inhibitor; (ii) a kinase inhibitor; (iii) a cytokine; (iv) an inhibitor of an immune inhibitory molecule; or (v) an agent that decreases the level or activity of a TREG cell; vi) an agent that increase the proliferation and/or persistence of CAR-modified cells vii) a chemokine viii) an agent that increases the expression of CAR (e.g., CAR I, CAR II, SIR, zSIR, Ab-TCR, TFP and the like) ix) an agent that allows regulation of the expression or activity of CAR (e.g., CAR I, CAR II, SIR, zSIR, Ab-TCR, TFP and the like), x) an agent that allows control over the survival and/or persistence of CAR-modified cells, xi) an agent that controls the side effects of CAR-modified cells, xii) a Brd4 inhibitor xiii) an agent that delivers a therapeutic (e.g. sHVEM) or prophylactic agent to the site of the disease, xiv) an agent that increases the expression of the target antigen against which CAR (e.g., CAR I, CAR II, SIR, zSIR, Ab-TCR, TFP and the like) is directed; xv) an adenosine A2a receptor antagonist; xvi) an agent that depletes monocytes and/or macrophages; xvii) Etoposide In some embodiments, a the genetically modified cells described herein may be used in a treatment regimen in combination with surgery, chemotherapy, radiation, immunosuppressive agents, such as cyclosporin, azathioprine, methotrexate, mycophenolate, and FK506, antibodies, or other immunoablative agents such as CAMPATH, anti-CD3 antibodies or other antibody therapies, cytoxin, fludarabine, cyclosporin, FK506, rapamycin, mycophenolic acid, steroids, FR901228, cytokines, and irradiation, peptide vaccine, such as that described in Izumoto et al 2008 J Neurosurg 108:963-971. In one embodiment, a CAR-expressing cell described herein can be used in combination with a chemotherapeutic agent. Exemplary chemotherapeutic agents include an anthracycline (e.g., doxorubicin (e.g., liposomal doxorubicin)), a *vinca* alkaloid (e.g., vinblastine, incristine, indesine, vinorelbine), an alkylating agent (e.g., cyclophosphamide, decarbazine, melphalan, ifosfamide, temozolomide), an immune cell antibody (e.g., alemtuzamab, gemtuiumab, rituximab, of atumumab, tositumomab, brentuximab), an antimetabolite (including, e.g., folic acid antagonists, pyrimidine analogs, purine analogs and adenosine deaminase inhibitors (e.g., fludarabine)), an mTOR inhibitor, a TNFR glucocorticoid induced TNFR related protein (GITR) agonist, a proteasome inhibitor (e.g., aclacinomycin A, gliotoxin or bortezomib), an immunomodulator such as thalidomide or a thalidomide derivative (e.g., lenalidomide).

In some embodiments, a CAR-expressing cell described herein is administered to a subject in combination with cyclophosphamide and fludarabine.

In some embodiments, a CAR-expressing cell described herein is administered to a subject who has been previously administered both myeloablative and lymphodepleting chemotherapy. Exemplary myeloablative and lymphodeleting conditioning regimens include FCE (Fludarabine 25 mg/m$^2$/day, days −7 to −3; cyclophosphamide 200 mg/m$^2$/day, days −7 to −3; and etoposide 250 mg/m$^2$/day, days −4 to −3), FCIE (Fludarabine 25 mg/m$^2$/day, days −7 to −3; cyclophosphamide 200 mg/m$^2$/day, days −7 to −3; idarubicin 12 mg/m$^2$/day, days −7 to −5 and etoposide 250 mg/m$^2$/day, days −4 to −3), FluCyE (fludarabine 30 mg/m$^2$/day, cytarabine 1.5 g/m$^2$/day administered following fludarabine and etoposide 100 mg/m$^2$/day with each of the drugs given on days −6 to −1), or FE (fludarabine 30 mg/m$^2$/day and Etoposide 100 mg/m$^2$/day on days −5 to day −1). In some embodiments, CAR-expressing cell are administered to the subject between 1 day to 5 days after the last dose of chemotherapy.

In some embodiments, a CAR-expressing cell described herein is administered to a subject who has been previously administered etoposide. In some embodiments, Etoposide is administered intravenously at a dose of 50 mg/m$^2$/day to 250 mg/m2/day for 1-5 days. In some embodiments, Etoposide is dosed at 5 mg/kg per dose for between 1 to 5 doses. In some embodiments, CAR-expressing cell are administered to the subject between 1 day to 5 days after the last dose of Etoposide.

In embodiments, a CAR-expressing cell described herein is administered to a subject in combination with bendamustine and rituximab.

In some embodiments, a CAR-expressing cell described herein is administered to a subject in combination with rituximab, cyclophosphamide, doxorubicin, vincristine, and/or a corticosteroid (e.g., prednisone). In embodiments, a CAR or next generation CAR-expressing cell described herein is administered to a subject in combination with rituximab, cyclophosphamide, doxorubicin, vincristine, and prednisone (R-CHOP). In embodiments, the subject has diffuse large B-celllymphoma (DLBCL).

In some embodiments, a CAR-expressing cell described herein is administered to a subject in combination with etoposide, prednisone, vincristine, cyclophosphamide, doxorubicin, and/or rituximab. In embodiments, a CAR or next generation CAR-expressing cell described herein is administered to a subject in combination with etoposide, prednisone, vincristine, cyclophosphamide, doxorubicin, and rituximab (EPOCH-R). In embodiments, a CAR-expressing cell described herein is administered to a subject in combination with dose adjusted EPOCH-R (DA-EPOCH-R). In embodiments, the subject has a B cell lymphoma, e.g., a Myc-rearranged aggressive B cell lymphoma.

In some embodiments, a CAR-expressing cell described herein is administered to a subject in combination with brentuximab. Brentuximab is an antibody-drug conjugate of anti-CD30 antibody and monomethyl auristatin E. In some embodiments, the subject has Hodgkin's lymphoma (HL), e.g., relapsed or refractory HL. In some embodiments, the subject comprises CD30+HL. In embodiments, the subject has undergone an autologous stem cell transplant (ASCT).

In some embodiments, a CAR-expressing cell described herein is administered to a subject in combination with a CD20 inhibitor, e.g., an anti-CD20 antibody (e.g., an anti-CD20 mono- or bispecific antibody) or a fragment thereof.

In one embodiment, a CAR-expressing cell described herein is administered to a subject in combination with an mTOR inhibitor, e.g., an mTOR inhibitor described herein, e.g., a rapalog such as everolimus. In one embodiment, the mTOR inhibitor is administered prior to the administration of CAR-expressing cell. For example, in one embodiment, the mTOR inhibitor can be administered prior to apheresis of the cells. In one embodiment, the subject has CLL.

In one embodiment, a CAR-expressing cell described herein can be used in combination with a kinase inhibitor. In one embodiment, the kinase inhibitor is a CDK4 inhibitor, e.g., a CDK4 inhibitor described herein, e.g., a CD4/6 inhibitor, such as, e.g., palbociclib or PD0332991. In one embodiment, the kinase inhibitor is a BTK inhibitor, e.g., a BTK inhibitor described herein, such as, e.g., ibrutinib. In some embodiments, ibrutinib is administered at a dosage of about 300-600 mg/day (e.g., about 300-350, 350-400, 400-450, 450-500, 500-550, or 550-600 mg/day, e.g., about 420 mg/day or about 560 mg/day), e.g., orally. In embodiments, the ibrutinib is administered at a dose of about 250 mg, 300 mg, 350 mg, 400 mg, 420 mg, 440 mg, 460 mg, 480 mg, 500 mg, 520 mg, 540 mg, 560 mg, 580 mg, 600 mg (e.g., 250 mg, 420 mg or 560 mg) daily for a period of time, e.g., daily for 21 day cycle, or daily for a 28 day cycle. In one embodiment, 1, 2, 3, 4, 5, 6, 7, 8, 9, 10, 11, 12 or more cycles of ibrutinib are administered.

In one embodiment, the kinase inhibitor is an mTOR inhibitor, e.g., an mTOR inhibitor described herein, such as, e.g., rapamycin, a rapamycin analog, OSI-027. In one embodiment, the kinase inhibitor is a dual PI3K/mTOR inhibitor described herein, such as, e.g., PF-04695102.

In one embodiment, the kinase inhibitor is a Src kinase inhibitor. In one embodiment, the kinase inhibitor is Dasatinib. In one embodiment, the Src kinase inhibitor is administered to the patient after the administration of CAR expressing cells to control or terminate the activity of CAR-expressing cells. In one embodiment, Dasatinib is administered to the patient after the administration of CAR-expressing cells to control or terminate the activity of CAR-expressing cells. In one embodiment, dasatinib is administered orally at a dose of at least 10 mg/day, 20 mg/day, 40 mg/day, 60 mg/day, 70 mg/day, 90 mg/day, 100 mg/day, 140 mg/day, 180 mg/day or 210 mg/day.

In embodiments, a CAR-expressing cell described herein is administered to a subject in combination with an anaplastic lymphoma kinase (ALK) inhibitor.

Drugs that inhibit either the calcium dependent phosphatase calcineurin (cyclosporine and FK506) or inhibit the p70S6 kinase that is important for growth factor induced signaling (rapamycin). (Liu et al., Cell 66:807-815, 1991; Henderson et al., Immun. 73:316-321, 1991; Bierer et al., Curr. Opin. Immun. 5:763-773, 1993) can also be used. In a further aspect, the cell compositions of the disclosure may be administered to a patient in conjunction with (e.g., before, simultaneously or following) bone marrow transplantation, T cell ablative therapy using chemotherapy agents such as, fludarabine, external-beam radiation therapy (XRT), cyclophosphamide, and/or antibodies such as OKT3 or CAMPATH. In one aspect, the cell compositions of the disclosure are administered following B-cell ablative therapy such as agents that react with CD20, e.g., Rittman. For example, in one embodiment, subjects may undergo standard treatment with high dose chemotherapy followed by peripheral blood stem cell transplantation. In certain embodiments, following the transplant, subjects receive an infusion of the expanded immune cells of the disclosure. In an additional embodiment, expanded cells are administered before or following surgery.

In embodiments, a CAR-expressing cell described herein is administered to a subject in combination with an autologous stem cell transplant, an allogeneic stem cell transplant, an autologous bone marrow transplant or an allogeneic bone marrow transplant.

In embodiments, a CAR-expressing cell described herein is administered to a subject in combination with microtransplant or HLA mismatched allogeneic cellular therapy (Guo M et al, J Clin Oncol. 2012 Nov. 20; 30(33):4084-90).

In embodiments, a CAR-expressing cell described herein is administered to a subject in combination with an indoleamine 2,3-dioxygenase (IDO) inhibitor.

In embodiments, a CAR-expressing cell described herein is administered to a subject in combination with a modulator of myeloid-derived suppressor cells (MDSCs).

In embodiments, a CAR-expressing cell described herein is administered to a subject in combination with a Brd4 or BET (bromodomain and extra-terminal motif) inhibitor. Exemplary Brd4 inhibitors that can be administered in combination with CAR-expressing cells include but are not limited to JQ1, MS417, OTXO15, LY 303511 and Brd4 inhibitor as described in US 20140256706 A1 and any analogs thereof.

In some embodiments, a CAR-expressing cell described herein is administered to a subject in combination with an interleukin-15 (IL-15) polypeptide, a interleukin-15 receptor alpha (IL-15Ra) polypeptide, or a combination of both a IL-15 polypeptide and a IL-15Ra polypeptide e.g., hetiL-15 (Admune Therapeutics, LLC). In some embodiments, het-IL-15 is administered subcutaneously.

In one embodiment, the subject can be administered an agent which reduces or ameliorates a side effect associated with the administration of a CAR-expressing cell. Side effects associated with the administration of a CAR-expressing cell include, but are not limited to CRS, and hemophagocytic lymphohistiocytosis (HLH), also termed Macrophage Activation Syndrome (MAS).

Accordingly, the methods described herein can comprise administering a CAR-expressing cell described herein to a subject and further administering one or more agents to manage elevated levels of a soluble factor resulting from treatment with a CAR-expressing cell. In one embodiment, the soluble factor elevated in the subject is one or more of IFN-γ, TNFa, IL-2 and IL-6. In an embodiment, the factor elevated in the subject is one or more of IL-1, GM-CSF, IL-10, IL-8, IL-5 and fraktalkine. Therefore, an agent administered to treat this side effect can be an agent that neutralizes one or more of these soluble factors. In one embodiment, the agent that neutralizes one or more of these soluble forms is an antibody or antigen binding fragment thereof. Examples of such agents include, but are not limited to a steroid (e.g., corticosteroid), Src inhibitors (e.g., Dasatinib) an inhibitor of TNFa, and an inhibitor of IL-6. An example of a TNFa inhibitor is an anti-TNFa antibody molecule such as, infliximab, adalimumab, certolizumab pegol, and golimumab. Another example of a TNFa inhibitor is a fusion protein such as entanercept. An example of an IL-6 inhibitor is an anti-IL-6 antibody molecule or an anti-IL-6 receptor antibody molecule such as tocilizumab (toe), sarilumab, elsilimomab, CNTO 328, ALD518/BMS-945429, CNTO 136, CPSI-2364, CDP6038, VX30, ARGX-109, FE301, and FM101. In one embodiment, the anti-IL-6 receptor antibody molecule is tocilizumab. In one embodiment, the IL-6 inhibitor is a camelid bispecific antibody that binds to IL6R and human serum albumin (e.g., IL6R-304-Alb8) (SEQ ID NO: 2649). An example of an IL-1R based inhibitor is anakinra. In one embodiment, an agent administered to treat the side effects of CAR-expressing cells is a Src inhibitor (e.g., Dasatinib). In one embodiment, an agent administered to treat the side effects of CAR-expressing cells is the Src inhibitor Dasatinib. In embodiments, Dasatinib is administered at a dose of about 10 mg/day to 240 mg/day (e.g., 10 mg/day, 20 mg/day, 40 mg/day, 50 mg/day, 70 mg/day, 80 mg/day, 100 mg/day, 110 mg/day, 120 mg/day, 140 mg/day, 180 mg/day, 210 mg/day, 240 mg/day or 300 mg/day).

In one embodiment, the subject can be administered an agent which enhances the activity of a CAR-expressing cell. For example, in one embodiment, the agent can be an agent which inhibits an inhibitory molecule. Inhibitory molecules, e.g., Programmed Death 1 (PD-1), can, in some embodiments, decrease the ability of a CAR-expressing cell to mount an immune effector response. Examples of inhibitory molecules include PD-1, PDL1, CTLA-4, TIM-3, CEACAM (e.g., CEACAM-1, CEACAM-3 and/or CEACAM-5), LAG-3, VISTA, BTLA, TIGIT, LAIR1, CD160, 2B4 and TGFR beta. Inhibition of an inhibitory molecule, e.g., by inhibition at the DNA, RNA or protein level, can optimize a CAR-expressing cell performance. In embodiments, an inhibitory nucleic acid, e.g., an inhibitory nucleic acid, e.g., a dsRNA, e.g., an siRNA or shRNA, a clustered regularly interspaced short palindromic repeats (CRISPR), a transcription-activator like effector nuclease (TALEN), or a zinc finger endonuclease (ZFN), e.g., as described herein, can be used to inhibit expression of an inhibitory molecule in the CAR-expressing cell. In an embodiment the inhibitor is an shRNA. In an embodiment, the inhibitory molecule is inhibited within a CAR-expressing cell. In these embodiments, a dsRNA molecule that inhibits expression of the inhibitory molecule is linked to the nucleic acid that encodes a component, e.g., all of the components, of the CAR. In one embodiment, the inhibitor of an inhibitory signal can be, e.g., an antibody or antibody fragment that binds to an inhibitory molecule. For example, the agent can be an antibody or antibody fragment that binds to PD-1, PD-L1, PD-L2 or CTLA4. In an embodiment, the agent is an antibody or antibody fragment that binds to TIM3. In an embodiment, the agent is an antibody or antibody fragment that binds to CEACAM (CEACAM-1, CEACAM-3, and/or CEACAM-5). In an embodiment, the agent is an antibody or antibody fragment that binds to LAG3.

Antibodies, antibody fragments, and other inhibitors of PD-1, PD-L1 and PD-L2 are available in the art and may be used combination with a CAR of the disclosure described herein. Pembrolizumab is a humanized IgG4 monoclonal antibody that binds to PD-1. In other embodiments, the agent that enhances the activity of a CAR-expressing cell is a CEACAM inhibitor (e.g., CEACAM-1, CEACAM-3, and/or CEACAM-5 inhibitor).

In one embodiment, the agent which enhances activity of a CAR-described herein is another agent that increases the expression of the target antigen against which the CAR is directed. The agents that can be administered to the subject receiving a CAR-expressing cell described herein include: Arsenic trioxide, ATRA (all-trans-retinoic acid), compounds 27, 40, 49 of (Du et al, Blood; Prepublished online Oct. 12, 2016), IDH2 inhibitors (e.g., AG-221) or a combination thereof. In an embodiment, the agents are administered prior to, concurrently or after administration of CAR-expressing cells. In preferred embodiments these agents are administered prior to administration of CAR-expressing cells. In preferred embodiment, the CAR expressing cells that are administered with the above agents target a B cell antigen (e.g., CD19, CD20, or CD22 etc.).

In one embodiment, the agent which enhances activity of a CAR or next generation CAR described herein is a soluble receptor. Soluble receptor that can be administered to the subject receiving a CAR-expressing cell described herein include: sHVEM (SEQ ID NO: 2664), sHVEM-Alb8-vHH fusion protein (SEQ ID NO: 2665), or a combination thereof. The soluble receptor can be administered once a day or more than once a day, e.g., twice a day, three times a day, or four times a day. The soluble receptor can be administered for more than one day, e.g. the soluble receptor is administered for 2 days, 3 days, 4 days, 5 days, 6 days, 1 week, 2 weeks, 3 weeks, or 4 weeks. For example, the soluble receptor is administered once a day for 7 days.

In one embodiment, the subject can be administered an agent which protects against the toxicity of a CAR-expressing cell on normal tissues. One of the limitations of CAR-T cell therapy could be toxicity on normal tissue. For example, CAR or next generation CAR targeting CD19 could lead to long-term depletion of normal B cells, which also express CD19 antigen. In one embodiment, CD19 CAR-T cell therapy can be combined with knock-out or mutation of endogenous CD19 in normal hematopoietic stem cells. In one embodiment, the knock out or mutation of the endogenous CD19 is achieved using CRIPS/Cas9, Talons or other suitable gene editing methods which are known in the art. The epitope of CD19 bound by the CD19 CAR-T cells in current clinical use has been mapped to exon2-4. In one embodiment, missense or nonsense mutations are generated in exon 2 (or other suitable exons/regions that are recognized by CD19 targeted CAR T-cells) of autologous or allogeneic hematopoietic stem cells using CRISP/Cas9, Zn finger nucleases, Talons or other methods known in the art. In one embodiment, the subject is given CD19 CAR-T cells infusion to control his/her disease and an autologous or allogeneic stem cell transplant using CD19 deleted/mutated hematopoietic stem cells. As the B cells that will originate from the modified stem cells will not be targeted by CD19-CAR-T cells, the patient will escape B cell aplasia which is a common side effect of CD19 CAR-T cells. In another embodiment, MPL CAR-T cell therapy is combined with knock-out or mutation of endogenous MPL in normal hematopoietic stem cells. In another embodiment, CD123 CAR-T cell therapy is combined with knock-out or mutation of endogenous CD123 in normal hematopoietic stem cells. In another embodiment, CD33 CAR-T cell therapy is combined with knock-out or mutation of endogenous CD33 in normal hematopoietic stem cells. In another embodiment, CD20 CAR-T cell therapy is combined with knock-out or mutation of endogenous CD20 in normal hematopoietic stem cells. In another embodiment, CD22 CAR-T cell therapy is combined with knock-out or mutation of endogenous CD22 in normal hematopoietic stem cells. In another embodiment, CS1 CAR-T cell therapy is combined with knock-out or mutation of endogenous CS1 in normal hematopoietic stem cells. In another embodiment, BCMA CAR-T cell therapy is combined with knock-out or mutation of endogenous BCMA in normal hematopoietic stem cells. In another embodiment, CD45 CAR-T cell therapy is combined with knock-out or mutation of endogenous CD45 in normal hematopoietic stem cells or immune effector cells (e.g., T cells or NK cells). Essentially, a similar approach could be used to mitigate the toxicity of CAR-T cells against normal tissue where the antigen targeted by the CAR or next generation CAR is also expressed on normal hematopoietic stem cells or one of its progenies.

In another embodiment, CAR-T cell therapy is combined with knock-out or mutation of endogenous gene or protein targeted by the CAR or next generation CAR in the immune effector cell (e.g., T cells or NK cells) or stem cells that give rise to immune effector cells. For example, since CD45 is expressed on all hematopoietic cells, CAR-T cells targeting CD45 would be difficult to generate as they would be killed off by neighboring CD45-CART cells. However, such cells can be generated if expression of CD45 CAR in T cells is combined with knock-down or deletion of endogenous CD45 in the T cells in which CD45 CAR or next generation CAR is being expressed. Essentially a similar approach can be used to generate CAR or next generation CAR targeting other antigens that are expressed on immune effector cells. Exemplary such antigens include, but are not limited to, CD5, TCRα, TCRβ1, TCRβ2, TCRγ, TCRδ, preTCRα and various receptors expressed on NK cells.

Cytokines that can be administered to the subject receiving a CAR-expressing cell described herein include: IL-2, IL-4, IL-7, IL-9, IL-15, IL-18, LIGHT, and IL-21, or a combination thereof. In preferred embodiments, the cytokine administered is IL-7, IL-15, or IL-21, IL12F, or a combination thereof. The cytokine can be administered once a day or more than once a day, e.g., twice a day, three times a day, or four times a day. The cytokine can be administered for more than one day, e.g. the cytokine is administered for 2 days, 3 days, 4 days, 5 days, 6 days, 1 week, 2 weeks, 3 weeks, or 4 weeks. For example, the cytokine is administered once a day for 7 days. In a preferred embodiment, the cytokine administered after administration of CAR-expressing cells is IL-7.

In one embodiment, the agent which enhances activity of a CAR-expressing cell described herein is a Brd4 inhibitor or an siRNA or an shRNA targeting BRD4 as described in (Tolani, B et al., Oncogene, 29; 33(22):2928-37. PMID: 23792448) (Tolani, Gopalakrishnan, Punj, Matta, & Chaudhary, 2014).

Also provided herein are pharmaceutical compositions comprising any one or more of the chimeric antigen receptors, the polynucleotides, the polypeptides, the vectors, the viruses, and/or the genetically engineered cells and/or chemical compounds described herein and a pharmaceutically acceptable carrier. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions of the disclosure are in one aspect formulated for intravenous administration.

Pharmaceutical compositions of the disclosure may be administered in a manner appropriate to the disease to be treated. The quantity and frequency of administration will be determined by such factors as the condition of the patient, and the type and severity of the patient's disease, although appropriate dosages may be determined by clinical trials.

When a "therapeutically effective amount" is indicated, the precise amount of the compositions of the disclosure to be administered can be determined by a physician with consideration of individual differences in age, weight, tumor size, extent of infection or metastasis, and condition of the patient (subject). It can generally be stated that a pharmaceutical composition comprising the genetically modified cells (T cells, NK cells) described herein may be administered at a dosage of $10^4$ to $10^9$ cells/kg body weight, in some instances $10^5$ to $10^6$ cells/kg body weight, including all integer values within those ranges. T cell compositions may also be administered multiple times at these dosages. The cells can be administered by using infusion techniques that are commonly known in immunotherapy (see, e.g., Rosenberg et al., New Eng. J. of Med. 319:1676, 1988).

In some embodiments, it may be desired to administer activated genetically modified cells (T cells, NK cells) to a subject and then subsequently redraw blood (or have an apheresis performed), activate the genetically modified cells therefrom and reinfuse the patient with these activated and expanded genetically modified cells. This process can be carried out multiple times every few weeks. In certain aspects, immune effector cells (e.g., T cells, NK cells) can be activated from blood draws of from 10 cc to 400 cc. In certain aspects, immune effector cells (e.g., T cells, NK cells) are activated from blood draws of 20 cc, 30 cc, 40 cc, 50 cc, 60 cc, 70 cc, 80 cc, 90 cc, or 100 cc.

"Pharmaceutically acceptable excipient" means an excipient that is useful in preparing a pharmaceutical composition that is generally safe, non-toxic, and desirable, and includes excipients that are acceptable for veterinary use as well as for human pharmaceutical use. Such excipients may be solid, liquid, semisolid, or, in the case of an aerosol composition, gaseous.

In various embodiments, the pharmaceutical compositions according to the disclosure may be formulated for delivery via any route of administration. "Route of administration" may refer to any administration pathway known in the art, including but not limited to aerosol, nasal, oral, intravenous, intramuscular, intraperitoneal, inhalation, transmucosal, transdermal, parenteral, implantable pump, continuous infusion, topical application, capsules and/or injections.

The pharmaceutical compositions according to the disclosure can also contain any pharmaceutically acceptable carrier. "Pharmaceutically acceptable carrier" as used herein refers to a pharmaceutically acceptable material, composition, or vehicle that is involved in carrying or transporting a compound of interest from one tissue, organ, or portion of the body to another tissue, organ, or portion of the body. For example, the carrier may be a liquid or solid filler, diluent, excipient, solvent, or encapsulating material, or a combination thereof. Each component of the carrier must be "pharmaceutically acceptable" in that it must be compatible with the other ingredients of the formulation. It must also be suitable for use in contact with any tissues or organs with which it may come in contact, meaning that it must not carry a risk of toxicity, irritation, allergic response, immunogenicity, or any other complication that excessively outweighs its therapeutic benefits.

The pharmaceutical compositions according to the disclosure can also be encapsulated, tableted or prepared in an emulsion or syrup for oral administration. Pharmaceutically acceptable solid or liquid carriers may be added to enhance or stabilize the composition, or to facilitate preparation of the composition. Liquid carriers include syrup, peanut oil, olive oil, glycerin, saline, alcohols and water. Solid carriers include starch, lactose, calcium sulfate, dihydrate, terra alba, magnesium stearate or stearic acid, talc, pectin, acacia, agar or gelatin. The carrier may also include a sustained release material such as glyceryl monostearate or glyceryl distearate, alone or with a wax.

The pharmaceutical preparations are made following the conventional techniques of pharmacy involving milling, mixing, granulation, and compressing, when necessary, for tablet forms; or milling, mixing and filling for hard gelatin capsule forms. When a liquid carrier is used, the preparation will be in the form of syrup, elixir, emulsion or an aqueous or non-aqueous suspension. Such a liquid formulation may be administered directly p.o. or filled into a soft gelatin capsule.

The pharmaceutical compositions according to the disclosure may be delivered in a therapeutically effective amount. The precise therapeutically effective amount is that amount of the composition that will yield the most effective results in terms of efficacy of treatment in a given subject. This amount will vary depending upon a variety of factors, including but not limited to the characteristics of the therapeutic compound (including activity, pharmacokinetics, pharmacodynamics, and bioavailability), the physiological condition of the subject (including age, sex, disease type and stage, general physical condition, responsiveness to a given dosage, and type of medication), the nature of the pharmaceutically acceptable carrier or carriers in the formulation, and the route of administration. One skilled in the clinical and pharmacological arts will be able to determine a therapeutically effective amount through routine experimentation, for instance, by monitoring a subject's response to administration of a compound and adjusting the dosage accordingly. For additional guidance, see Remington: The Science and Practice of Pharmacy (Gennaro ed. 20th edition, Williams & Wilkins PA, USA) (2000).

The administration of the subject compositions may be carried out in any convenient manner, including by aerosol inhalation, injection, transfusion, implantation or transplantation. The compositions described herein may be administered to a patient trans-arterially, subcutaneously, intradermally, intratumorally, intranodally, intramedullary, intramuscularly, by intravenous (i.v.) injection, or intraperitoneally. In one aspect, the T cell compositions of the disclosure are administered to a patient by intradermal or subcutaneous injection. In one aspect, the T cell compositions of the disclosure are administered by i. v. injection. The compositions of immune effector cells (e.g., T cells, NK cells) may be injected directly into a tumor, lymph node, or site of infection.

In a particular exemplary aspect, subjects may undergo leukapheresis, wherein leukocytes are collected, enriched, or depleted ex vivo to select and/or isolate the cells of interest, e.g., T cells. These T cell isolates may be expanded by methods known in the art and treated such that one or more CAR or next generation CAR constructs of the disclosure may be introduced, thereby creating a CAR-T cell of the disclosure. Subjects in need thereof may subsequently undergo standard treatment with high dose chemotherapy followed by peripheral blood stem cell transplantation. In certain aspects, following or concurrent with the transplant, subjects receive an infusion of the expanded CAR-T cells of the disclosure. In an additional aspect, expanded cells are administered before or following surgery.

In one embodiment, the CAR is introduced into immune effector cells (e.g., T cells, NKT cells), e.g., using in vitro transcription, and the subject (e.g., human) receives an initial administration of CAR or next generation CAR immune effector cells (e.g., T cells, NKT cells) of the disclosure, and one or more subsequent administrations of the CAR or next generation CAR immune effector cells (e.g., T cells, NK cells) of the disclosure, wherein the one or more subsequent administrations are administered less than 15 days, e.g., 14, 13, 12, 11, 10, 9, 8, 7, 6, 5, 4, 3, or 2 days after the previous administration. In one embodiment, more than one administration of the CAR or next generation CAR immune effector cells (e.g., T cells, NK cells) of the disclosure are administered to the subject (e.g., human) per week, e.g., 2, 3, or 4 administrations of the CAR or next generation CAR immune effector cells (e.g., T cells, NK cells) of the disclosure are administered per week. In one embodiment, the subject (e.g., human subject) receives more than one administration of the CAR immune effector cells (e.g., T cells, NK cells) per week (e.g., 2, 3 or 4 administrations per week) (also referred to herein as a cycle), followed by a week of no CAR or next generation CAR immune effector cells (e.g., T cells, NK cells) administrations, and then one or more additional administration of the CAR or next generation CAR immune effector cells (e.g., T cells, NK cells) (e.g., more than one administration of the CAR or next generation CAR immune effector cells (e.g., T cells, NK cells) per week) is administered to the subject. In another embodiment, the subject (e.g., human subject) receives more than one cycle of CAR or next generation CAR immune effector cells (e.g., T cells, NK cells), and the time between each cycle is less than 10, 9, 8, 7, 6, 5, 4, or 3 days. In one embodiment, the CAR or next generation CAR immune effector cells (e.g., T cells, NK cells) are administered every other day for 3 administrations per week. In one embodiment, the CAR immune effector cells (e.g., T cells, NK cells) of the disclosure are administered for at least two, three, four, five, six, seven, eight or more weeks.

A potential issue that can arise in patients being treated using transiently expressing CAR or next generation CAR immune effector cells (e.g., T cells, NK cells) (particularly with murine scFv bearing CAR-Ts) is anaphylaxis after multiple treatments.

Without being bound by this theory, it is believed that such an anaphylactic response might be caused by a patient developing humoral anti-CAR response, i.e., anti-CAR antibodies having an anti-IgE isotype. It is thought that a patient's antibody producing cells undergo a class switch from IgG isotype (that does not cause anaphylaxis) to IgE isotype when there is a ten to fourteen days break in exposure to antigen.

If a patient is at high risk of developing an anaphylactic response to CAR or next generation CAR therapy or generating an IgE type CAR antibody response during the course of CAR or next generation CAR therapy, then omalizumab (Xolair) can be administered before or during the CAR or next generation CAR therapy.

If a patient is at high risk of generating an anti-CAR antibody response during the course of transient CAR or next generation CAR therapy (such as those generated by RNA transductions), CAR-T infusion breaks should not last more than ten to fourteen days.

Kits to practice the disclosure are also provided. For example, kits for treating a cancer in a subject, or making a CAR-T cell that expresses one or more of the CARs or next generation CARs disclosed herein. The kits may include a nucleic acid molecule or a polypeptide molecule encoding a CAR or next generation CAR or a vector encoding a CAR or next generation CAR along with a method to introduce the nucleic acid into the immune effector cells. The kit may include a virus comprising a nucleic acid encoding a CAR or next generation CAR and chemicals, such as polybrene, to enhance the virus transduction. The kit may contain components for isolation of T cells for expressing a CAR or next generation CAR. Alternatively, the kit may contain immune effector cells (e.g., T cells or NK cells) or stem cells expressing a CAR or next generation CAR. More than one of the disclosed CAR can be included in the kit. The kit can include a container and a label or package insert on or associated with the container.

Suitable containers include, for example, bottles, vials, syringes, etc. The containers may be formed from a variety of materials such as glass or plastic. The container typically holds a composition including one or more of the nucleic acid molecules, viruses, vectors, T cells expressing a CAR or next generation CAR. In several embodiments the container may have a sterile access port (for example the container may be an intravenous solution bag or a vial having a stopper pierceable by a hypodermic injection needle). A label or package insert indicates that the composition is used for treating the particular condition. The label or package insert typically will further include instructions for use of a disclosed nucleic acid molecules, CARs or next generation CARs or T cells expressing a CAR or next generation CAR, for example, in a method of treating or preventing a tumor or of making a CAR-T cell. The package insert typically includes instructions customarily included in commercial packages of therapeutic products that contain information about the indications, usage, dosage, administration, contraindications and/or warnings concerning the use of such therapeutic products. The instructional materials may be written, in an electronic form (such as a computer diskette or compact disk) or may be visual (such as video files). The kits may also include additional components to facilitate the particular application for which the kit is designed. Thus, for example, the kit may additionally contain means for measuring the expression of CAR or next generation CAR on T cells or of determining the number or percentage of T cells that express the CAR or of determining the functionality of CAR-T cells. The kits may additionally include buffers and other reagents routinely used for the practice of a particular method. Such kits and appropriate contents are well known to those of skill in the art.

Animal models can also be used to measure CAR activity. For example, xenograft model using human cancer associated antigen described herein-specific CARP T cells to treat a primary human pre-B-ALL in immunodeficient mice can be used. See, e.g., Milone et al., Molecular Therapy 17(S): 1453-1464 (2009).

Dose dependent CAR treatment response can be evaluated. See, e.g., Milone et al., Molecular Therapy 17(S): 1453-1464 (2009).

Assessment of cell proliferation and cytokine production has been previously described, e.g., at Milone et al., Molecular Therapy 17(S): 1453-1464 (2009).

Cytotoxicity can be assessed by Matador assay or using a standard $^{51}$Cr-release assay. See, e.g., Milone et al., Molecular Therapy 17(8): 1453-1464 (2009).

Imaging technologies can be used to evaluate specific trafficking and proliferation of zSIRs in tumor-bearing animal models. Such assays have been described, for example, in Barrett et al., Human Gene Therapy 22:1575-1586 (2011).

Other assays, including those described in the Example section herein as well as those that are known in the art can also be used to evaluate the CAR described herein.

EXAMPLES

The activity of a CAR can be tested by several in vitro and in vivo assays described herein and below. A general scheme for generating, selecting and using suitable CARs is provided below:

Identification of target for CAR generation. A suitable target against which the CAR is designed is selected based on search of the literature or gene expression databases. In general, a suitable target for a CAR shows higher expression on the disease causing or disease associated cells as compared to normal healthy cells.

Generation of CAR. Once a candidate target antigen for CAR is identified, the antigen binding domain of CAR is designed based on information available in the literature. In general, the antigen binding domain of CAR is typically based on an antibody, an antibody fragments, scFV, or camelid vHH domains. The sequences of the variable chains of heavy (vH) and light (vL) chains of antibodies, the camelid vHH domains and various receptors and ligands can be obtained by sequencing or by publically available databases and can be used for synthesis of a CAR using the methods described herein as shown in different examples. The sequences comprising the antigen binding domains of CAR are codon optimized and synthesized artificially using publically available software (e.g. ThermoFisher or IDT) and commercial vendors (e.g. IDT). The resulting fragments are PCR amplified and cloned in different vectors containing the different CAR backbones using standard Molecular Biology techniques. The different CAR backbones are described in WO 2016/187349 A1, PCT/US2016/058305, U.S. 62/429,597, PCT/US17/64379 and PCT/US2017/024843, which are incorporated in their entirely herein by reference. In general, CAR constructs are typically cloned in a lentiviral vector. The sequences of the constructs are confirmed using automated sequencing.

Another exemplary construct encoding a zSIR is pLenti-EF1α-CD8SP-BCMA-Am06-HL-vL-IgCL-Bam-CD3zECDTMCP-opt-F-P2A-Spe-SP-Bst-BCMA-Am06-HL-vH-IgG1-CH1-KPN-CD3zECDTMCP-opt2-F-F2A-Xba-PAC-DWPRE (SEQ ID NO: 154). This construct has many convenient restriction sites so that the antigen binding domain fragments (e.g., vL and vH domains) can be cut out and replaced with the antigen binding domain fragments targeting other antigens. The vector carries an Nhe I site upstream of the CD8 Signal peptide (CD8SP), which can be also used along with the Xho I site to clone in a new vL fragment carrying a 5' signal peptide. The BstB I and Mlu I sites can be used to replace the vH fragment. The Xho I and Spe I sites can be used to replace the module encoding IgCL-[IgCL-Bam-CD3zECDTMCP-opt-F-P2A with a different module. Similarly, the MluI and Xba sites can be used to replace the module containing IgG1-CH1-KPN-CD3zECDTMCP-opt2-F-F2A. The accessory module encoding PAC can be replaced using the Xba I (or Nde I) and SalI restriction sites. Thus, a person with ordinary skills in the art can use this vector and the sequence of the antigen binding domain (e.g., vL and vH domains of an antibody) to generate zSIRs targeting any other new antigen.

Generation of secretory antigen-NLuc fusion proteins and antigen binding domain (ABD)-NLuc fusion proteins. (Optional step).

Secretory antigen-NLuc fusion proteins and antigen binding domain (ABD)-NLuc fusion proteins were generated and used as described in PCT/US2017/025602, which is incorporated herein in its entirety by reference. A panel of cell lines are tested for binding to the ABD-NLuc fusion protein to identify cell lines that express high level of CAR target and therefore can be used to test the activity of CAR. Table A provides an exemplary list of cell lines expressing different antigen targets that can be used to assay for the activity of a CAR of this disclosure. The cell lines expressing the target of CAR can be also identified using alternate methods such as literature search, immunostaining with commercially available antibodies or by searching publically available gene expression databases.

The immune effector cells expressing CAR are tested in the following assays to identify the functional CAR.

(A) Topanga Assay (NLuc binding assay): The control vector- and CAR-expressing Jurkat-NFAT-GFP or T cells are stained with the target Antigen-Nluc fusion protein (as described above) and their ability to bind to the target antigen is assayed by measuring Nluc activity. For example, Jurkat-NFAT-GFP cells expressing FMC63 based CAR targeting CD19 show increased binding to CD19-NLuc fusion protein as compared to control vector expressing Jurkat-NFAT-GFP cells or parental Jurkat-NFAT-GFP cells.

(B) Induction of NFAT promoter driven GFP expression. The control vector- and CAR-expressing Jurkat-NFAT-GFP cocultured for 4-24 hours with the target antigen-expressing cell line (described above) and their ability to bind to the target antigen is assayed by measuring induction of GFP expression using Flow Cytometry. Cellular supernatant is collected and assayed for the induction of cytokines (e.g., IL2).

(C) Assay for cytokine production: The control vector- and CAR-expressing Jurkat-NFAT-GFP or T cells are cocultured with the target cell lines for 4-96 hours and supernatant examined for induction of cytokines (e.g., IL2, IFNγ, TNFα etc.) expression using ELISA.

(D) Assay for Cytotoxic Activity in vitro and in vivo: The uninfected T cells or those expressing a control vector or CAR are cocultured with the target cell lines expressing a non-secretory form of a luciferase (such as GLuc, NLuc, Turboluc 16 etc.) for 4-96 hours and induction of cell lysis examined by measuring the luciferase activity as described in PCT/US17/52344. Alternate methods for measurement of cytotoxic activity (e.g., $^{51}$Cr release assay or LDH release assay) can be used as well. The activity of T cells expressing a CAR can be also assayed in vivo using appropriate xenograft models in immunodeficient mice.

Based on the above methods, a person with ordinary skilled in the art can easily design, construct, test and select the appropriate functioning CAR or pool of CARs against any antigen. The CAR or a pool of CARs can be used for human clinical trials and clinical use for the prevention and treatment of various disease conditions. Table 11 provides an exemplary list of human disease conditions that can be treated using the CARs of the disclosure.

It is possible that different CARs or subset of CARs are optimally suited for different disease conditions depending on various factors including, but not limited to, the prevelance and level of expression of the target antigen on disease causing and disease-associated cells, disease burden and rate of progression of the disease. Different CARs may be optimally suited even for a single disease condition in different patients depending on their efficacy and toxicity profile and the condition of the patient. The disclosure provides a solution to the significant technical and logistical hurdles to generating a diverse adoptive immune response.

Normal TCR diversity is produced by gene rearrangement. Rigorous positive and negative selection processes in the thymus ensure that only T cells expressing the αβ TCR that are restricted to recognizing self-peptides/MHC within a low affinity range can populate the periphery. Thus, the thymic environment allows the generation of a pool of αβ T cells that are self-restricted, but not self-reactive.

Generating a diverse pool of CARs from different antigen binding domains is limited by the technical and financial hurdles of generating and testing multiple antigen binding domains. More importantly, as each of the antigen binding domains (e.g., vL and vH fragments of an antibody) has a potential of binding other antigens and causing off-target toxicity, a diverse pool of CARs based only on a plurality of antigen binding domains potentially has an increased risk of toxicity. Therefore, the potential diversity of such a pool would have to be limited to reduce off-target toxicity. The current disclosure overcomes this problem by generating a diverse pool of CARs from a single or a few antigen binding domains by attaching them to different variants of TCR chains. The diversity of the CAR pool is further increased by the use of different linkers. The diversity of T cells expressing the pool can be further increased by use of different accessory modules and therapeutic controls described in the disclosure.

This diverse pool of CARs can be used to provide a diverse immune response against disease causing or disease associated cells expressing the said antigen. Alternatively, the diverse pool of CARs can be optionally DNA barcoded (SEQ ID NO: 123-128) sing techniques known the art and subsequently used to select a single or a subgroup of CARs with optimal biological and clinical characteristics. These characteristics may include but are not limited to, performance in the in vitro biological assays (e.g., cytotoxicity, cytokine secretion, binding affinity, cell surface expression, off-target effects, T cell proliferation, expression of exhaustion markers and terminal differentiation etc.), performance in the in vivo assays (e.g., survival, tumor reduction, T cell persistence, T cell expansion etc.) and clinical experience (e.g., disease remission, relapse rate, toxicities, etc.). The CARs of the disclosure can be used singly or in combination with other natural and synthetic immune receptors known in the art to generate a diverse pool of immune effector cells for the prevention and treatment of various disease conditions caused by or associated with cells expressing their target antigens.

Gene fragments encoding the different signal peptides, antibody binding domains, linkers, TCR constant chains, cleavable linkers and selection markers (e.g., PAC, EGFP, CNB30 etc.) were artificially synthesized in single or multiple fragments using a commercial supplier (IDT) and used as templates in PCR reactions with primers containing appropriate restriction enzymes. The amplified fragments were digested with appropriate restriction enzymes and then cloned in the pLENTI-EF1α(SEQ ID NO: 129), pLENTI-EF1α-DWPRE (SEQ ID NO: 130), pCCLc-MNDU3-WPRE (SEQ ID NO: 12639) or MSCV-Bg12-AvrII-Bam-EcoR1-Xho-BstB1-Mlu-Sal-ClaI.I03 (SEQ ID NO: 131) vectors using standard molecular biology techniques. The CAR fragments were cloned between the Nhe I and Sal I sites in the pLENTI-EF1α (SEQ ID NO: 129), pLENTI-EF1α-DWPRE (SEQ ID NO: 130), pCCLc-MNDU3-WPRE (SEQ ID NO: 12639) vectors. The resulting fragment can then be used as a template in PCR reaction with primers containing appropriate restriction enzymes. The amplified fragment can be digested with appropriate restriction enzymes and then cloned in the appropriate vector using standard molecular biology techniques.

Cell lines engineered to express luciferases (e.g., GLuc or NLuc) for measuring cytotoxicity of different constructs targeting different cell surface and intracellular antigens are provided in Table A. Cell lines used in this experiments, target antigens on the cells lines and their growth media are shown in the following Table A. Cells were cultured at 37° C., in a 5% CO2 humidified incubator. The cell lines were obtained from ATCC, NIH AIDS reagent program or were available in the laboratory.

TABLE A

| Cell line | Culture Conditions | Exemplary CAR Target Antigens Expressed |
|---|---|---|
| BC-1 | RPMI, 20% FCS | BCMA, GPRC, CD138 |
| BC-3 | RPMI, 20% FCS | BCMA, GPRC, CD138 |
| BCBL-1 | RPMI, 20% FCS | GPRC, CD138 |
| JSC-1 | RPMI, 20% FCS | GPRC, CD138 |
| MM1S | RPMI, 10% FCS | CD38, GPRC, CD44, CD200R |
| U266 | RPMI, 10% FCS | BCMA, WT1/HLA-A2+, CS1, CLL1, CD138, c-MET, IL6R, CD179b, NY-ESO/HLA-A2, NYBR, LAMP1 |
| L363 | RPMI, 10% FCS | BCMA, GPRC, WT1/HLA-A2+, CS1, CLL1, CD138, NY-ESO/HLA-A2, NYBR, LAMP1 |
| K562 | RPMI, 10% FCS | CD33, IL1Ra, TnAg |
| BV173 | RPMI, 10% FCS | CD123, CD179b, IL1Ra, WT1/HLA-A2+,CXCR4, FLT3, CD179a |
| Nalm6 | RPMI, 10% FCS | CD19, CD20, CD22, CD179b, CD179a |
| HL60 | RPMI, 10% FCS | CD33, CD34, CLL1, IL6R, CD32, CD179 |
| U937 | RPMI, 10% FCS | CD4, CLL1 |
| RS4:11 | RPMI, 20% FCS | CD19, Folate Receptor beta (FRbeta), TGFbeta, CD179b, NKG2D, FLT3, CD179a, CD133 |
| MV4;11 | RPMI, 10% FCS | FLT3,CD123, FRbeta |
| Raji | RPMI, 10% FCS | CD19, CD20, CD22, BCMA, CD38, CD70, CD79, Folate Receptor beta, CLL1 |
| HEL-92.1.7 (HEL) | RPMI, 10% FCS | MPL, CD33, CD32, CD200R, Cripto |
| Jurkat | RPMI, 10% FCS | TnAg, TSLRP, TSHR, CD4, CD38 |
| Daudi | RPMI, 10% FCS | BCMA, FRbeta |
| REC-1 | RPMI, 10% FCS | NKG2D, ROR1, CD19, FCRH5, BAFF-R |
| KG-1 | RPMI, 20% FCS | CD33, CD34, CD123, TSLRP, EMR2, VISTA, BST1 |
| CEM | RPMI, 10% FCS | CD5, CD43 |
| U937 | RPMI, 10% FCS | CD4, CLL1 |
| LAMA5 | RPMI, 10% FCS | WT1/HLA-A2 |
| A549 | DMEM, 10% FCS | ROR1, CD22, TIM1, CDH17 |
| HT29 | DMEM, 10% FCS | EGFR, SLEA, c-MET |
| Molm-13 | RPMI, 20% FCS | FLT3, IL6R, LAMP1, TSLRP, CD4, CSF2RA, CXCR4, IL6R, CSF2RA, GPC3, EMR2, BST1 |
| A431 | DMEM, 10% FCS | EGFR, Folate Receptor Alpha (FOLR1), Her3 |
| P19 | DMEM, 10% FCS | SSEA |

TABLE A-continued

| Cell line | Culture Conditions | Exemplary CAR Target Antigens Expressed |
|---|---|---|
| THP-1 | RPMI, 10% FCS | CD32, CD33, CXCR4, CD123, CD44, IL6R, Folate Receptor beta, CD70, LAMP1, FLT3, CSF2RA, IL1RAP |
| U87MG | DMEM, 10% FCS | CD276, gpNMB, IL13RA2, MMP16 |
| LoVo | DMEM, 10% FCS | Tissue Factor, CDH17, EGFR, CEA, RNF43 |
| SKOV-3 | DMEM, 10% FCS | Folate Receptor alpha (FR1), FSHR, Her2, Her3, LHR, MSLN, TIM1, EPCAM |
| NCI-H1993 | DMEM, 10% FCS | EGFR |
| Kasumi-1 | RPMI, 20% FCS | CLEC5A, PR1/HLA-A2, TGFbeta, |
| Jeko-1 | RPMI, 20% FCS | BCMA, ROR1, BAFF-R |
| PC-3 | DMEM, 10% FCS | CGH, TROP2, PSCA, PSMA. EPCAM, FSHR, CLD18A2 (CLDN18.2), STEAP1 |
| HeLa | DMEM, 10% FCS | EGFR, FR1, MSLN, TSHR |
| LNCaP | DMEM, 10% FCS | EGFR, FSHR, PSCA, PSMA, CD22, Her3, LHR, CLD18A2 (CLDN18.2), STEAP1, BMPR1B |
| OVCAR-3 | DMEM, 10% FCS | B7H4, CDH6, DLL3, FR1, FSH, LHR, MSLN, PTK7, TnAg, TSHR, L1CAM, LYPD1, CLDN6, UPK1B, CD133, SLC34A2 |
| MEL-624 | DMEM, 10% FCS | CDH19, GD2, GD3, gp100/HLA-A2, gpNMB, HMWMAA, NYESO/HLA-A2, MART1/HLA-A2 |
| LS174-T | DMEM, 10% FCS | CEA |
| MEL-526 | DMEM, 10% FCS | GD2 |
| MDA-MB231 | DMEM, 10% FCS | CD324, Muc1 |
| MDA-MB-453 | DMEM, 10% FCS | Nectin-4,; WISP1 |
| L1236 | RPMI, 20% FCS | CD30, CD23, PDL1 |
| L428 | RPMI, 20% FCS | CD30, CD123, CCR4, PDL1 |
| L540 | RPMI, 20% FCS | CD30, CCR4, PDL1 |
| Molt-16 | RPMI, 20% FCS | IL1ra, NKG2D |
| CEM | RPMI, 10% FCS | CD5 |
| MG-63 | DMEM, 10% FCS | IL13RA2 |
| Karpass-299 | RPMI, 20% FCS | Alk, GPRC, PDL1 |
| MCF7 | DMEM, 10% FCS | B7D4, CD276, TROP2, Her3, Muc1, LewisY, LHR, Prolactin Receptor (PRLR), Liv-1 |
| AA-2 | RPMI, 10% FCS | HIV1 env glycoprotein (gp120) |
| HL2/3 | DMEM, 10% FCS | HIV1 env glycoprotein (gp120) |
| TF228.1.16 | DMEM, 10% FCS | HIV1 env glycoprotein (gp120), CCR4 |
| TT | DMEM, 10% FCS | TGF-Beta, TSHR, GFRalpha4 |
| DMS79 | RPMI, 10% FCS | Fucosyl-GM1, Slea (CA19.9; Sialyl Lewis Antigen) |
| LAN-5 | DMEM, 10% FCS | ALK, DLL3, GFRalpha4, FUCOSYL-GM1 |
| PEER1 | RPMI, 10% FCS | TSHR |
| SK-MEL-37 | DMEM, 10% FCS | DLL3, GD2 |
| F9 | DMEM, 10% FCS | SSEA |
| HepG2 | DMEM, 10% FBS | GPC3, AFP/HLA-A2, CLDN6 |

Jurkat cell line (clone E6-1) engineered with a NFAT-dependent GFP reporter gene was a gift from Dr. Arthur Weiss at UCSF. Jurkat cells were maintained in RPMI-1640 medium supplemented with 10% FBS, penicillin and streptomycin.

Generation of Lentiviruses and retroviruses. Lentiviruses were generated by calcium phosphate based transfection in 293FT cells essentially as described previously (Matta, Hozayev, Tomar, Chugh, & Chaudhary, 2003). 293FT cells were grown in DMEM with 10% FCS 4 mM L-Glutamine, 0.1 mM MEM Non-Essential Amino Acids, and 1 mM MEM Sodium Pyruvate (hereby referred to as DMEM-10). For generation of lentivirus, 293FT cells were plated in 10 ml of DMEM-10 medium without antibiotics in a 10 cm tissue culture plate so that they will be approximately 80% confluent on the day of transfection. The following day, the cells were transfected by calcium phosphate transfection method using 10 μg of lentiviral expression plasmid encoding different genes, 7.5 μg of PSPAX2 plasmid and 2 μg of PLP/VSVG plasmid. In some experiment, the transfection mixture also contained between 2.5 to 5 μg of an HIV1 Vif encoding plasmid (SEQ ID NO: 11269). Approximately 15-16 hours post-transfection, 9 ml of media was removed and replaced with 5 ml of fresh media. Approximately, 48 hours post-transfection, 5 ml of supernatant was collected (first collection) and replaced with fresh 5 ml media. Approximately 72 hrs post-transfection, all media was collected (second collection, usually around 6 ml). The collected supernatants were pooled and centrifuged at 1000 rpm for 1 minute to remove any cell debris and non-adherent cells. The cell-free supernatant was filtered through 0.45 μm syringe filter. In some cases, the supernatant was further concentrated by ultra-centrifugation at 18500 rpm for 2 hours at 4° C. The viral pellet was re-suspended in 1/10 of the initial volume in XVIVO medium. The virus was either used fresh to infect the target cells or stored frozen in aliquots at −80° C.

Infection of T cells and PBMC. Buffy coat cells were obtained from healthy de-identified adult donors from the Blood Bank at Children Hospital of Los Angeles and used to isolate peripheral blood mononuclear cells (PBMC) by Ficoll-Hypaque gradient centrifugation. PBMC were either used as such or used to isolate T cells using CD3 magnetic microbeads (Miltenyi Biotech) and following the manufacturer's instructions. PBMC or isolated T cells were re-suspended in XVIVO medium (Lonza) supplanted with 10 ng/ml CD3 antibody, 10 ng/ml CD28 antibody and 100 IU recombinant human-IL2. Alternatively, CD3/CD28 beads and 100 IU recombinant human-IL2 were used. Cells were cultured at 37° C., in a 5% CO2 humidified incubator. Cells were activated in the above medium for 1 day prior to infection with lentiviral vectors. In general, primary cells (e.g. T cells) were infected in the morning using spin-infection (1800 rpm for 90 minutes at 37° C. with 300 μl of concentrated virus that had been re-suspended in XVIVO medium in the presence of 8 μg/ml of Polybrene® (Sigma, Catalog no. H9268). The media was changed in the evening and the infection was repeated for two more days for a total of 3 infections. After the 3rd infection, the cells were pelleted and resuspended in fresh XVIVO media containing 10 ng/ml CD3 antibody, 10 ng/ml CD28 antibody and 100 IU recombinant human-IL2 and supplemented with respective antibiotics (if indicated) and placed in the cell culture flask for selection, unless indicated otherwise. Alternatively, CD3/CD28 beads and 100 IU recombinant human-IL2 were used. Cells were cultured in the above medium for 10-15 days in case no drug selection was used and for 20-30 days in case drug-selection was used. In cases, where cells were infected with a lentivirus expressing EGFP, they were expanded without drug-selection or flow-sorted to enrich for EGFP-expressing cells. For infection of cancer cell lines, approximately 500,000 cells were infected with 2 ml of the un-concentrated viral supernatant in a total volume of 3 ml with Polybrene® (Sigma, Catalog no. H9268). Then next morning, the cells were pelleted and resuspended in the media with respective antibiotics and place in the cell culture flask for selection.

Essentially a similar procedure as described above for lentivirus vector production was used for generation of retroviral vectors with the exception that 293FT cells were generally transfected in 10 cm tissue culture plates in 10 ml of DMEM-10 medium using 10 μg of retroviral construct, 4 μg of pKAT and 2 μg of VSVG plasmid. The virus collection and infection of target cells was carried out essentially as described above for lentiviral vectors.

Antibodies and drug. Digitonin was purchased from Sigma (Cat. no D141) and a stock solution of 100 mg/ml was made in DMSO. A diluted stock of 1 mg/ml was made in PBS. Final concentration of digitonin used for cell lysis was 30 μg/ml unless indicated otherwise.

Clinical Grade CAR-T Manufacturing and Administration

For clinical grade CAR-T manufacturing, cGMP grade lentiviruses encoding the CARs are generated using commercial sources (e.g., Lentigen, Lonza etc.). The T cell are collected from donors (autologous or allogeneic) using leukapheresis. CAR-T cells are manufactured using CLINIMAC Prodigy (Miltenyi Biotech) automated closed system as described (Zhu F, Shah N et al, Cytotherapy, 2017) and following the instructions of the manufacturer. The multiplicity of infection (MOI) of between 5 to 10 is used. Alternate methods for clinical grade CAR-T manufacturing, such as Cocoon (Lonza) and manual open systems, are known in the art and can be used in alternate embodiment of the invention. CAR-T cells are administered to the patient after lympho-depleting chemotherapy at escalating doses starting at approximately of $1\times10^6$ CD3 CAR-T cells/kg.

IL2 ELISA. Human IL2, IFNγ, IL6 and TNFa was measured in the cell culture supernatant of CAR-expressing Jurkat-NFAT-GFP effector cells or T cells that had been co-cultured with the specific target cell lines for 24 to 96 hours using ELISA kits from R&D systems (Minneapolis, MN) and following the recommendations of the manufacturer.

FACS analysis. Mouse Anti-Human c-Myc APC-conjugated Monoclonal Antibody (Catalog #IC3696A) was from R&D Systems (Minneapolis, MN). Biotinylated protein L was purchased from GeneScript (Piscataway, NJ), reconstituted in phosphate buffered saline (PBS) at 1 mg/ml and stored at 4° C. Streptavidin-APC (SA1005) was purchased from ThermoFisher Scientific.

For detection of CARs using Myc staining, $1\times10^6$ cells were harvested and washed three times with 3 ml of ice-cold 1×PBS containing 4% bovine serum albumin (BSA) wash buffer. After wash, cells were resuspended in 0.1 ml of the ice-cold wash buffer containing 10 μl of APC-conjugated Myc antibody and incubated in dark for 1 hour followed by two washings with ice cold wash buffer.

For detection of CARs using Protein L staining, $1\times10^6$ cells were harvested and washed three times with 3 ml of ice-cold 1×PBS containing 4% bovine serum albumin (BSA) wash buffer. After wash, cells were resuspended in 0.1 ml of the ice-cold wash buffer containing 1 μg of protein L at 4° C. for 1 hour. Cells were washed three times with ice-cold wash buffer, and then incubated (in the dark) with 10p1 of APC-conjugated streptavidin in 0.1 ml of the wash buffer for 30 minutes followed by two washings with ice cold wash buffer. FACS was done using FACSVerse analyzer from BD Biosciences.

Cell death assay. To measure cell death, a novel assay based on ectopic cytosolic expression of Gluc or NLuc was utilized as described in PCT/US17/52344 "A Non-Radioactive Cytotoxicity Assay".

Development of an Assay to detect the expression of CAR and their antigens. To detect the expression of CAR and their target antigens, a luciferase based reporter assay, designated Matador Assay was utilized as described in PCT/US2017/025602 "A Highly Sensitive And Specific Luciferase Based Reporter Assay For Antigen Detection".

Jurkat NFAT-GFP Assay for CARs. The Jurkat-NFAT-GFP cells are engineered in such a way that the IL-2 promoter, which carries NFAT binding sites, is cloned upstream of the GFP gene. These cells have been used to study signaling via TCR and CAR. The different CARs were stably expressed in Jurkat NFAT-GFP cells by lentiviral mediated gene transfer, followed by selection with puromycin. The CAR-expressing Jurkat-NFAT-GFP cells were cocultured with the target cells at E:T ratio of approximately 1:2 for approximately 4 hours to 18 hours. When the interaction between CARs and their target antigen results in activation of the NFAT pathway, GFP expression is induced. Hence Jurkat-NFAT-GFP cells expressing CAR show increased levels of GFP expression when they interact with target cell lines expressing the receptor for the CAR.

Induction of GFP expression by coculturing of Jurkat-NFAT-GFP cells expressing different CAR constructs and the different target cells was studied essentially as described previously (Wu, Roybal, Puchner, Onuffer, & Lim, 2015). GFP expression was monitored by FACS analysis. The Jurkat-NFAT-GFP (parental) cells were used as control. The results with different CARs are summarized in the following summary Table 14. The names of different CARs, their SEQ ID NOs, component antigen binding domains and TCR chains can be determined by reference to Tables 14. A CAR is considered positive in the assay in case the CAR expressing Jurkat-NFAT-GFP cells show greater % GFP positive cells when cultured with the target cell line as compared to parental Jurkat-NFAT-GFP cells. Thus, the Jurkat-NFAT-GFP cells expressing the BCMA CAR represented by SEQ ID NO: 495 showed greater induction of GFP expression when cocultured with the L363 and U266 cells as compared to parental Jurkat-NFAT-GFP cells. The signs +/−, +, 2+ etc. after the name of the cell lines indicate the relative degree of positivity on the Jurkat-NFAT-GFP assay as measured by the % GFP positive cells after culture of the CAR expressing Jurkat-NFAT-GFP cells with that cell line. The results also demonstrate that different CARs containing the binding domain derived from the same antibody show great diversity in their ability to activate NFAT signaling using this assay when exposed to the identical cell line depending upon the CAR type. In addition, great diversity of response against the same target cell line is observed with Jurkat cells expressing CARs containing different antigen binding domains targeting the same antigen (e.g., CARs having antigen binding domains derived form different BCMA antibodies) even when the CARs share the same CAR architecture (e.g., BBz CAR or SIR). Finally, Jurkat cells expressing CARs targeting different antigens (e.g. CD19 vs CD20) show a diversity of response when exposed to the same target cell line. Thus, a diverse immune response can be generated against a single target cell by combining CARs with different TCR chains, linkers, antigen binding domains and target specificity. Table 14 also summarizes the results of GLuc based T cell cytotoxicity assay (Matador Assay) observed with different CARs when exposed to their target cell lines. The signs +/−, + and 2+ etc indicate the degree of cytoxicity observed using the Gluc cytotoxicity assay following 4-96 hours co-culture of the target cell line with CAR-expressing T cells as compared to control T cells, i.e., T cells expressing no CAR or an irrelevant CAR (e.g., a CAR targeting an antigen not expressed on the particular target cell line), when the assay is performed under similar conditions. Again, similar to the results obtained with Jurkat-NFAT-GFP cells, T cells expressing different CARs show great diversity in their ability to exert cytotoxicity when exposed to their target antigen expressing cells depending upon their TCR chains, linkers, antigen binding domains, target specificity and the target cell line. A similar diversity in the ability to induce cytokine production (e.g. IL2, TNFα and IFNγ) is observed among T cells expressing different CARs depending upon their TCR chains, linkers, antigen binding domains, target specificity and the target cell line when they were exposed to the target cell line under comparable conditions. Based on the results of this analysis, different antigen binding domains (e.g., scFv), linkers, CAR type and class, and TCR chains and their configurations that were positive in the NFAT-GFP and T cell cytotoxicity assays were selected for further studies.

TABLE 14

| Target | SEQ ID NO | Constructs Name | NFAT-GFP ASSAY Positive Cell lines | T-CELL Cytotoxicity Assay Positive cell line |
|---|---|---|---|---|
| BCMA | 446 | CD8SP-BCMA-Am08-HL-vH-Gly-Ser-Linker-vL-Myc-CD8TM-BBz | L363(2+), U266 (2+) | |
| BCMA | 543 | CD8SP-BCMA-BB-CAR02-vL-Gly-Ser-Linker-BCMA-BB-CAR02-vH-Myc-CD8TM-BBz | | L363 (+), U266 (+) |
| BCMA | 545 | CD8SP-BCMA-BB-CAR02-vL-Gly-Ser-Linker-BCMA-BB-CAR02-vH-Myc-CD8TM-z-P2A-K13-FLAG-T2A-PAC | | L363 (+), U266 (+) |
| BCMA | 495 | CD8SP-BCMA-Am14-HL-vH-Gly-Ser-Linker-vL-Myc-CD8TM-BBz | L363(2+), U266 (2+) | L363(+), U266 (+) |
| BST1 | 8506 | CD8SP-hu-BST1-A1-vL-Gly-Ser-Linker-hu-BST1-A1-vH-Myc-CD8TM-z-P2A-K13-FLAG-T2A-PAC | Kasumi (+/−) | HL60 (+) |
| BST1 | 8604 | CD8SP-hu-BST1-A3-vL-Gly-Ser-Linker-hu-BST1-A3-vH-Myc-CD8TM-z-P2A-K13-FLAG-T2A-PAC | Kasumi (+/−), MOLM13 (+/−) | HL60 (+) |
| BST1 | 8553 | CD8SP-hu-BST1-A2-vL-Gly-Ser-Linker-hu-BST1-A2-vH-Myc-CD8TM-BBz | HL60 (+/−) | |
| BST1 | 8602 | CD8SP-hu-BST1-A3-vL-Gly-Ser-Linker-hu-BST1-A3-vH-Myc-CD8TM-BBz | Kasumi (2+), MOLM13 (+/−), HL60 (+/−) | |
| CD19 | 791 | CD8SP-CD19-AM1-vL-[hTCRa-CSDVP]-F-F2A-SP-CD19-AM1-vH-[hTCRb-KACIAH]-F-P2A-Xba-PAC | RAJI (2+), Nalm6 (+), REH (+/−) | |
| CD19 | 984 | CD8SP-hu-CD19-USC1-LH4-vL-Gly-Ser-Linker-hu-CD19-USC1-LH4-vH-Myc-CD8TM-BBz | RAJI (2+), Nalm6 (+), REH (+) | |
| CD19 | 742 | CD8SP-CD19-9B7-vL-[hTCRa-CSDVP]-F-F2A-SP-CD19-9B7-vH-[hTCRb-KACIAH]-F-P2A-Xba-PAC | RAJI (+), Nalm6 (+/−), REH (+/−) | |
| CD19 | 937 | CD8SP-CD19-DART1-vL-Gly-Ser-Linker-CD19-DART1-vH-Myc-CD8TM-z-P2A-K13-FLAG-T2A-PAC | RAJI (2+), Nalm6 (2+) | RAJI (+), Nalm6 (+) |
| CD19 | 935 | CD8SP-CD19-DART1-vL-Gly-Ser-Linker-CD19-DART1-vH-Myc-CD8TM-BBz | RAJI (2+), Nalm6 (2+) | |

TABLE 14-continued

| Target | SEQ ID NO | Constructs Name | NFAT-GFP ASSAY Positive Cell lines | T-CELL Cytotoxicity Assay Positive cell line |
|---|---|---|---|---|
| CD19 | 788 | CD8SP-CD19-AM1-vL-Gly-Ser-Linker-CD19-AM1-vH-Myc-CD8TM-BBz | RAJI (2+), Nalm6 (2+) | |
| CD19 | 739 | CD8SP-CD19-9B7-vL-Gly-Ser-Linker-CD19-9B7-vH-Myc-CD8TM-BBz | RAJI (2+), Nalm6 (2+) | |
| CD19 | 887 | CD8SP-hu-CAT18-1-HL-vH-Gly-Ser-Linker-vL-Myc-CD8TM-BBz | RAJI (3+), Nalm6 (3+) | |
| CD19 | 838 | CD8SP-hCD19-CAT17-HL-vH-Gly-Ser-Linker-vL-Myc-CD8TM-BBz | RAJI (4+), Nalm6 (3+) | RAJI (+) |
| CD19 | 3956 | CD8-hCD19-EUK5-13-vL-IgCL-Xho-CD3zECDTMCP-opt-F-P2A-Spe-SP-Bst-hCD19-EUK5-13-vH-IgG1-CH1-Mlu-CD3zECDTMCP-opt2-F-F2A-PAC | RAJI(2+), NALM6 (2+) | |
| CD19 | 8663 | CD8SP-hu-Bu13-vL-[hTCRb-KAC-ECD-Bam-CD3zECDTMCP-opt]-F-P2A-SP-hu-Bu13-vH-[hTCRa-CSDVP-ECD-Kpn-CD3zECDTMCP-opt2] | RAJI (+), Nalm6 (+) | |
| CD19 | 8651 | CD8SP-hu-Bu13-vL-Gly-Ser-Linker-hu-Bu13-vH-Myc-CD8TM-BBz | RAJI (2+), Nalm6 (+) | RAJI (+/−), Nalm6 (+) |
| CD19 | 8655 | CD8SP-hu-Bu13-vL-PG4SP-v2-[hTCRb-KACIAH]-F-P2A-SP-hu-Bu13-vH-PG4SP-[hTCRa-CSDVP]-F-F2A-PAC | RAJI (2+), Nalm6 (2+) | |
| CD19 | 8654 | CD8SP-hu-Bu13-vL-[hTCRa-CSDVP]-F-F2A-SP-hu-Bu13-vH-[hTCRb-KACIAH]-F-P2A-Xba-PAC | RAJI (3+), Nalm6 (3+) | RAJI (+), Nalm6 (+), Bv173(+) |
| CD19 | 8634 | CD8SP-V5-[hTCRb-KACIAH]-F-P2A-CD8SP-hu-Bu13-vL-Gly-Ser-Linker-hu-Bu13-vH-Myc-[hTCRa-CSDVP]-F-F2A-PAC | RAJI (+) NALM6 (+/−) | RAJI (+), Nalm6 (+), Bv 173 (+) |
| CD19 | 3955 | CD8-HCD19-EUK5-13-vL-IgCL-Bam-CD3zECDTMCP-opt-F-P2A-Spe-SP-Bst-hCD19-EUK5-13-vH-IgG1-CH1-KPN-CD3zECDTMCP-opt2-F-F2A-Xba-PAC | RAJI (3+) NALM6 (2+) | |
| CD19 | 3961 | CD8SP-CD19Bu12-scFv-Xho-CD3zECDTMCP-opt-F-P2A-SP-CD19MM-scFv-Mlu-CD3zECDTMCP-opt2-F-F2A-PAC | RAJI (2+), NALM6 (2+) | |
| CD19-AFP | 3964 | CD8SP-CD19Bu12-scFv-Xho-CD3zECDTMCP-opt-F-P2A-SP-AFP-61-scFv-Mlu-CD3zECDTMCP-opt2-F-F2A-PAC | RAJI(2+), NALM6(+) | |
| CD19-CD20 | 3963 | CD8SP-CD19Bu12-scFv-Xho-CD3zECDTMCP-opt-F-P2A-SP-CD20-2F2-scFv-Mlu-CD3zECDTMCP-opt2-F-F2A-PAC | RAJI(+), NALM6 (+) | |
| CD19-CD22 | 3966 | CD8SP-CD19Bu12-scFv-Xho-CD3zECDTMCP-opt-F-P2A-SP-hSC22-10-HL-scFv-Mlu-CD3zECDTMCP-opt2-F-F2A-PAC | RAJI(+), NALM6 (+) | |
| CD19-CD22 | 3965 | CD8SP-CD19Bu12-scFv-Xho-CD3zECDTMCP-opt-F-P2A-SP-CD22-h10F4v2-scFv-Mlu-CD3zECDTMCP-opt2-F-F2A-PAC | RAJI(+), NALM6 (+) | |
| CD19-CD123 | 3967 | CD8SP-CD19Bu12-scFv-Xho-CD3zECDTMCP-opt-F-P2A-SP-CD123-DART1-scFv-Mlu-CD3zECDTMCP-opt2-F-F2A-PAC | RAJI (+), NALM6 (+), L428(+) | |
| CD19-CD123 | 3962 | CD8SP-CD19Bu12-scFv-Xho-CD3zECDTMCP-opt-F-P2A-SP-CD123-DART2-scFv-Mlu-CD3zECDTMCP-opt2-F-F2A-PAC | RAJI (+), NALM6 (+), L428 (2+) | |
| CD19-WT1 | 3968 | CD8SP-CD19Bu12-scFv-Xho-CD3zECDTMCP-opt-F-P2A-SP-WT1-Ab5-scFv-Mlu-CD3zECDTMCP-opt2-F-F2A-PAC | RAJI(+), Nalm6 (+) | |

TABLE 14-continued

| Target | SEQ ID NO | Constructs Name | NFAT-GFP ASSAY Positive Cell lines | T-CELL Cytotoxicity Assay Positive cell line |
|---|---|---|---|---|
| CD20 | 1084 | CD8SP-hu-Ubli-1-v4-vL-Gly-Ser-Linker-hu-Ubli-1-v4-vH-Myc-CD8TM-z-P2A-K13-FLAG-T2A-PAC | RAJI (2+) | RAJI (+) |
| CD20 | 1082 | CD8SP-hu-Ubli-1-v4-vL-Gly-Ser-Linker-hu-Ubli-1-v4-vH-Myc-CD8TM-BBz | RAJI (2+) | RAJI (+) |
| CD20 | 1034 | CD8SP-CD20-HL-vH-Gly-Ser-Linker-vL-Myc-CD8TM-BBz | RAJI (2+) | |
| CD22 | 1131 | CD8SP-hCD19-hu-HA22-1-vL-Gly-Ser-Linker-hCD19-hu-HA22-1-vH-Myc-CD8TM-BBz | RAJI (2+), Nalm6 (+/-) | |
| CD44v6 | 1181 | CD8SP-CD44v6-USC1-HL4-vH-Gly-Ser-Linker-vL-Myc-CD8TM-BBz | L363 (+/-) U266 (+/-) | |
| CLDN6 | 1526 | CD8SP-CLDN6-USC2-LH4-vL-[hTCRa-CSDVP]-F-F2A-SP-CLDN6-USC2-LH4-vH-[hTCRb-KACIAH]-F-P2A-PAC | | HepG2 (+/-), OVCAR3 (+/-) |
| CLDN6 | 1523 | CD8SP-CLDN6-USC2-LH4-vL-Gly-Ser-Linker-CLDN6-USC2-LH4-vH-Myc-CD8TM-BBz | HepG2(+), OVCAR (+) | |
| CLDN6 | 1476 | CD8SP-CLDN6-USC1-LH4-vL-Gly-Ser-Linker-CLDN6-USC1-LH4-vH-Myc-CD8TM-z-P2A-K13-FLAG-T2A-PAC | HepG2(+/-), OVCAR3 (+/-) | |
| CRIPTO | 8879 | CD8SP-V5-[hTCRb-KACIAH]-F-P2A-CD8SP-hu-Cripto-L1H2-vL-Gly-Ser-Linker-hu-Cripto-L1H2-vH-Myc-[hTCRa-CSDVP]-F-F2A-PAC | | HEL (+) |
| DLL3 | 1575 | CD8SP-DLL3-AM6-HL-vL-[hTCRa-CSDVP]-F-F2A-SP-DLL3-AM6-HL-vH-[hTCRb-KACIAH]-F-P2A-PAC | SKMEL 37 (+/-) | |
| DLL3 | 1622 | CD8SP-DLL3-AM14-HL-vH-Gly-Ser-Linker-vL-Myc-CD8TM-BBz | LAN5 (+), SKMEL 37 (+/-) | SKMEL 37 (+) |
| DLL3 | 1573 | CD8SP-DLL3-AM6-HL-vH-Gly-Ser-Linker-vL-Myc-CD8TM-BBz | LAN5 (+/-), SKMEL 37 (+/-) | |
| EGFRvIII | 1771 | CD8SP-EGFRviii-H2M1863N2-HL-vL-[hTCRa-CSDVP]-F-F2A-SP-EGFRviii-H2M1863N2-HL-vH-[hTCRb-KACIAH1-F-P2A-Xba-PAC | | HeLa (+), HeLa EGFRvIII (+) |
| EGFRvIII | 1769 | CD8SP-EGFRviii-H2M1863N2-HL-vH-Glv-Ser-Linker-vL-Myc-CD8TM-BBz | Hela (+/), HeLa EGFR (+/-), LoVo (+/-), A431(4+) | |
| EMR2 | 1915 | CD8SP-EMR2-USC2-V4-vL-Gly-Ser-Linker-EMR2-USC2-V4-vH-Myc-CD8TM-BBz | MOLM13 (+), HL60(+/-) | |
| FOLR1 | 2064 | CD8SP-FOLR1-USC1-HL4-vL-Gly-Ser-Linker-FOLR1-USC1-HL4-vH-Myc-CD8TM-z-P2A-K13-FLAG-T2A-PAC | Hela (2+), A431 (+/-) | |
| gpA33 | 9026 | CD8SP-V5-[hTCRb-KACIAH]-F-P2A-CD8SP-hu-gpA33-vL-Gly-Ser-Linker-hu-gpA33-vH-Myc-[hTCRa-CSDVP]-F-F2A-PAC | | MOLM13 (+) |
| GPC3 | 2210 | CD8SP-GPC3-USC2-HL-V4-vH-Gly-Ser-Linker-vL-Myc-CD8TM-BBz | HcpG (3+) MOLM13 (+/-) | |
| GPC3 | 2161 | CD8SP-GPC3-USC1-HL-V4-vH-Gly-Ser-Linker-vL-Myc-CD8TM-BBz | HepG (3+) MOLM13 (+/-) | |
| Her2 | 2309 | CD8SP-Her2-169-vL-Gly-Ser-Linker-Her2-169-vH-Myc-CD8TM-z-P2A-K13-FLAG-T2A-PAC | | MCF7 (+/-) |

TABLE 14-continued

| Target | SEQ ID NO | Constructs Name | NFAT-GFP ASSAY Positive Cell lines | T-CELL Cytotoxicity Assay Positive cell line |
|---|---|---|---|---|
| Her2 | 2457 | CD8SP-Her2-XMT-1520-vL-[hTCRa-CSDVP]-F-F2A-SP-Her2-XMT-1520-vH-[hTCRb-KACIAH]-F-P2A-Xba-PAC | MCF7(2+) | |
| Her2 | 2408 | CD8SP-Her2-XMT-1518-vL-[hTCRa-CSDVP]-F-F2A-SP-Her2-XMT-1518-vH-[hTCRb-KACIAH]-F-P2A-Xba-PAC | MCF7(+) | |
| Her2 | 2405 | CD8SP-Her2-XMT-1518-vL-Gly-Ser-Linker-Her2-XMT-1518-vH-Myc-CD8TM-BBz | MCF7(+) | |
| Her2 | 2454 | CD8SP-Her2-XMT-1520-vL-Gly-Ser-Linker-Her2-XMT-1520-vH-Myc-CD8TM-BBz | MCF7 (2+) | |
| Her2 | 2456 | CD8SP-Her2-XMT-1520-vL-Gly-Ser-Linker-Her2-XMT-1520-vH-Myc-CD8TM-Z-P2A-K13-FLAG-T2A-PAC | MCF7 (+/−) | |
| Her2 | 2405 | CD8SP-Her2-XMT-1518-vL-Gly-Ser-Linker-Her2-XMT-1518-vH-Myc-CD8TM-BBz | MCF7 (2+) | |
| Her2 | 2356 | CD8SP-Her2-huMab4D5-D98W-vL-Gly-Ser-Linker-Her2-huMab4D5-D98W-vH-Myc-CD8TM-BBz | MCF7 (+/−) | |
| IL1RAP | 9242 | CD8SP-IL1RAP-IAPB63-vL-[hTCRa-CSDVP]-F-F2A-SP-IL1RAP-IAPB63-vH-[hTCRb-KACIAH]-F-P2A-Xba-PAC | MOLM13 (+/−) | MOLM13 (+) |
| IL1RAP | 9222 | CD8SP-V5-[hTCRb-KACIAH]-F-P2A-CD8SP-IL1RAP-IAPB63-vL-Gly-Ser-Linker-IL1RAP-IAPB63-vH-Myc-[hTCRa-CSDVP]-F-F2A-PAC | | MOLM13 (+) |
| Integrin B7 | 2552 | CD8SP-Hu-IntB7-MMG49-vL-Gly-Ser-Linker-Hu-IntB7-MMG49-vH-Myc-CD8TM-BBz | | L363 (+), U266 (+) |
| LYPD1 | 2650 | CD8SP-LYPD1-HL-V4-vL-Gly-Ser-Linker-LYPD1-HL-V4-vH-Myc-CD8TM-BBz | OVCAR3 (2+) | |
| MSLN | 2849 | CD8SP-MSLN-237-HL-vL-[hTCRa-CSDVP]-F-F2A-SP-MSLN-237-HL-vH-[hTCRb-KACIAH]-F-P2A-Xba-PAC | SKOV3 (+) | SKOV3 (7+) |
| MSLN | 2800 | CD8SP-MSLN-5-HL-vL-[hTCRa-CSDVP]-F-F2A-SP-MSLN-5-HL-vH-[hTCRb-KACIAH]-F-P2A-Xba-PAC | SKOV3 (+) | SKOV3 (5+) |
| MSLN | 2944 | CD8SP-MSLN-HuAM15-vL-Gly-Ser-Linker-MSLN-HuAM15-vH-Myc-CD8TM-BBz | SKOV3 (+) | |
| MSLN | 2749 | CD8SP-MSLN-3-HL-AM-vH-Gly-Ser-Linker-vL-Myc-CD8TM-BBz | SKOV3 (+) | |
| MSLN | 2798 | CD8SP-MSLN-5-HL-vH-Gly-Ser-Linker-vL-Myc-CD8TM-BBz | SKOV3 (+/−) | |
| MSLN | 9435 | CD8SP-MSLN-hu22A10-vL-Gly-Ser-Linker-MSLN-hu22A10-vH-MyC-CD8TM-BBz | SKOV3 (2+) | |
| MSLN | 9387 | CD8SP-MSLN-7D9-v3-vH-Gly-Ser-Linker-vL-Myc-CD8TM-BBz | SKOV3 (3+) | |
| MSLN | 9389 | CD8SP-MSLN-7D9-v3-vL-[hTCRa-CSDVP]-F-F2A-SP-MSLN-7D9-v3-vH-[hTCRb-KACIAH]-F-P2A-Xba-PAC | SKOV3 (2+) | |
| MSLN | 9398 | CD8SP-MSLN-7D9-v3-vL-[hTCRb-KAC-ECD-Bam-CD3zECDTMCP-opt]-F-P2A-SP-MSLN-7D9-v3-vH-[hTCRa-CSDVP-ECD-Kpn-CD3zECDTMCP-opt2] | SKOV3 (+) | |
| MSLN | 9439 | CD8SP-MSLN-hu22A10-vL-PG4SP-v2-[hTCRb-KACIAH]-F-P2A-SP-MSLN-hu22A10-vH-PG4SP-[hTCRa-CSDVP]-F-F2A-PAC | SKOV3 (2+) | SKOV3 (+) |

TABLE 14-continued

| Target | SEQ ID NO | Constructs Name | NFAT-GFP ASSAY Positive Cell lines | T-CELL Cytotoxicity Assay Positive cell line |
|---|---|---|---|---|
| MSLN | 9447 | CD8SP-MSLN-hu22A10-vL-[hTCRb-KAC-ECD-Bam-CD3zECDTMCP-opt]-F-P2A-SP-MSLN-hu22A10-vH-[hTCRa-CSDVP-ECD-Kpn-CD3zECDTMCP-opt2] | SKOV3 (+) | |
| MSLN | 9419 | CD8SP-V5-[hTCRb-KACIAH]-F-P2A-CD8SP-MSLN-hu22A10-vL-Gly-Ser-Linker-MSLN-hu22A10-vH-Myc4-[preTCRa-Del48]-F-F2A-PAC | SKOV3 (+/−) | SKOV3 (+) |
| MSLN | 2898 | CD8SP-MSLN76923-HL-vL-[hTCRa-CSDVP]-F-F2A-SP-MSLN76923-HL-vH-[hTCRb-KACIAH]-F-P2A-PAC | | SKOV3 (+/−) |
| MSLN | 9369 | CD8SP-V5-[hTCRb-KACIAH]-F-P2A-CD8SP-MSLN-7D9-v3-vL-Gly-Ser-Linker-MSLN-7D9-v3-vH-Myc-[hTCRa-CSDVP]-F-F2A-PAC | SKOV3 (+) | SKOV3 (+) |
| Muc17 | 3045 | CD8SP-Muc17-11-CN-vL-[hTCRa-CSDVP]-F-F2A-SP-Muc17-11-CN-vH-[hTCRb-KACIAH]-F-P2A-Xba-PAC | SKOV3 (+) | |
| SLC34A2 | 3581 | CD8SP-huMX35-LH4-vL-Gly-Ser-Linker-huMX35-LH4-vH-Myc-CD8TM-BBz | OVCAR3 (3+) | |
| Nectin-4 | 3092 | CD8SP-Nectin4-66-HL-vH-Gly-Ser-Linker-vL-Myc-CD8TM-BBz | MDAMB231 (+/−), MCF7 (2+) | MDAMB231 (+), MCF7 (+) |
| PRLR | 3143 | CD8SP-PRLR-CN-vL-[hTCRa-CSDVP]-F-F2A-SP-PRLR-CN-vH-[hTCRb-KACIAH]-F-P2A-Xba-PAC | MCF7 (+) | |
| PRLR | 3191 | CD8SP-PRLR-USC2-HL-V4-vL-Gly-Ser-Linker-PRLR-USC2-HL-V4-vH-Myc-CD8TM-z-P2A-K13-FLAG-T2A-PAC | MCF7 (2+) | MCF7 (+/−) |
| PRLR | 3140 | CD8SP-PRLR-CN-vL-Gly-Ser-Linker-PRLR-CN-vH-Myc-CD8TM-BBz | MCF7 (2+) | |
| PSMA | 3241 | CD8SP-hu106mPSMA-4-HL-vL-[hTCRa-CSDVP]-F-F2A-SP-hul06mPSMA-4-HL-vH-[hTCRb-KACIAH]-F-P2A-Xba-PAC | | PC3 (+), LNCAP (+) |
| PSMA | 3290 | CD8SP-PSMA-76-HL-AM-vL-[hTCRa-CSDVP]-F-F2A-SP-PSMA-76-HL-AM-vH-[hTCRb-KACIAH]-F-P2A-Xba-PAC | PC3 (+/−) | |
| PSMA | 3239 | CD8SP-hu106mPSMA-4-HL-vH-Gly-Ser-Linker-vL-Myc-CD8TM-BBz | PC3 (+/−) | |
| PSMA | 3337 | CD8SP-PSMA-83A12-HL-AM-vH-Gly-Ser-Linker-vL-Myc-CD8TM-BBz | PC3 (+/−) | |
| RNF43 | 3386 | CD8SP-RNF43-USC1-HL4-vH-Gly-Ser-Linker-vL-Myc-CD8TM-BBz | LoVo (+/−) | LoVo (+/−) |
| ROR1 | 9516 | CD8SP-V5-[hTCRb-KACIAH]-F-P2A-CD8SP-ROR1-DART4-vL-Gly-Ser-Linker-ROR1-DART4-vH-Myc-[hTCRa-CSDVP]-F-F2A-PAC | | Jekol (+) |
| STEAP | 3534 | CD8SP-STEAP1-USC1-HL4-vL-Gly-Ser-Linker-STEAPI-USC1-HL4-vH-Myc-CD8TM-z-P2A-K13-FLAG-T2A-PAC | PC3 (+) LNCAP (+/−) | |
| STEAP | 9565 | CD8SP-V5-[hTCRb-KACIAH]-F-P2A-CD8SP-STEAP1-hu120-vL-Gly-Ser-Linker-STEAP1-hu120-vH-Myc-[hTCRa-CSDVP]-F-F2A-PAC | | PC3 (+) LNCAP (+) |
| TSHR | 3630 | CD8SP-TSHR-hu-3BD10-vL-Gly-Ser-Linker-TSHR-hu-3BD10-vH-Myc-CD8TM-BBz | | MOLM13 (1.5+) |
| UISP1 | 3924 | CD8SP-hu-UISP1-USC2-LH4-vL-Gly-Ser-Linker-hu-UlSPl-USC2-LH4-vH-Myc-CD8TM-BBz | MDAMB231 (+/−) | |

TABLE 14-continued

| Target | SEQ ID NO | Constructs Name | NFAT-GFP ASSAY Positive Cell lines | T-CELL Cytotoxicity Assay Positive cell line |
|---|---|---|---|---|
| UPK1B | 3730 | CD8SP-hUPK1B-USC2-LH4-vL-Gly-Ser-Linker-hUPK1B-USC2-LH4-vH-Myc-CD8TM-z-P2A-K13-FLAG-T2A-PAC | OVCAR3 (2+) Sudhl1 (+) | |
| UPK1B | 3681 | CD8SP-hUPK1B-USC1-LH4-vL-Glv-Ser-Linker-hUPK1B-USC1-LH4-vH-Myc-CD8TM-z-P2A-K13-FLAG-T2A-PAC | Sudhl-1(+) | |
| UPK1B | 3682 | CD8SP-hUPK1B-USC1-LH4-vL-[hTCRa-CSDVP]-F-F2A-SP-hUPK1B-USC1-LH4-vH-[hTCRb-KACIAH]-F-P2A-Xba-PAC | OVCAR3 (2+) Sudhl 1 (+) | OVCAR (2+), Sudhl 1 (1.5+) |
| VISTA | 3780 | CD8SP-huVISTA-JJ-USC2-v4-vL-[hTCRa-CSDVP]-F-F2A-SP-huVISTA-JJ-USC2-v4-vH-[hTCRb-KACIAH]-F-P2A-Xba-PAC | KG1 (+/−) MOLM13 (+/−) HL60 (+/−) | |
| VISTA | 3826 | CD8SP-huVISTA-USC1-v4-vL-Gly-Ser-Linker-huVISTA-USC1-v4-vH-Myc-CD8TM-BBz | | MOLM13(+) |
| BCMA | 12755 | CD8SP-BCMA-Am06-HL-Mlu-MYC-CD8TM-BBZ-XS-T2A-Pac | L363(+), U266 (+) | |
| BCMA | 12894 | CD8SP-BCMA-huC13-F12-vL-V5-[hTCRb-KACIAH]-F-P2A-SP-BCMA-huC13-F12-vH-Myc-[hTCRa-CSDVP]-F-F2A-PAC | L363(2+), U266 (2+) | |
| BCMA | 546 | CD8SP-BCMA-BB-CAR02-vL-[hTCRa-CSDVP]-F-F2A-SP-BCMA-BB-CAR02-vH-[hTCRb-KACIAH]-F-P2A-PAC | L363(2+), U266 (+) | |
| BCMA | 497 | CD8SP-BCMA-Am14-HL-vL-[hTCRa-CSDVP]-F-F2A-SP-BCMA-Am14-HL-vH-[hTCRb-KACIAH]-F-P2A-PAC | L363(2+), U266 (+) | |
| BCMA | 12921 | BCMA-huC13-F12vL-Myc2-[hTCRb-KACIAH]-F-P2A-BCMA-huC13-F12vH-MYC4-[hTCRa-CSDVP]-F-F2A-PAC | L363(+), U266 (+) | L363(+), U266 (+) |
| BCMA | 449 | CD8SP-BCMA-Am08-HL-vL-PG4SP-v2-[hTCRb-KACIAH]-F-P2A-SP-BCMA-Am08-HL-vH-PG4SP-[hTCRa-CSDVP]-F-F2A-PAC | L363(+), U266 (+) | |
| BCMA | 16316 | CD8SP-BCMA-huC13-F12-BBz | L363(2+), U266 (+) | L363 (+), U266 (+), Raji (+), Nalm6 (+) |
| BCMA | 13028 | CD8SP-BCMA-J6M0-vL-[hTCRβ-KACIAH]-F-P2A-SP-BCMA-J6M0-vH-Mlu-huTCRα-CSDVP | L363(+/−) | |
| BCMA | 12922 | CD8SP-BCMA-huC13-F12-vL-[hTCRb-KACIAH]-F-P2A-SP-BCMA-huC13-F12-vH-[hTCRa-CSDVP]-F-F2A-PAC | L363(+), U266 (+) | L363(+), U266 (+) |
| BCMA | 12944 | CD8SP-BCMA-huC13-F12-vL-[hTCRb-S57C]-F-P2A-SP-BCMA-huC13-F12-vH-[hTCRa-T48C]-F-F2A-K13-opt | L363(3+), U266 (3+) | |
| BCMA | | BCMA-HuC12A3-L3H3-BBZ | L363(1.5+), U266 (+) | L363 (+), U266 (+), Raji(+), Nalm6 (+) |
| BCMA | 12890 | CD8SP-BCMA-huC12A3-L3H3-vL-[hTCRb-S57C]-F-P2A-SP-BCMA-huC12A3-L3H3-vH-[hTCRa-T48C] | | L363 (+), U266 (+), Raji(+), Nalm6 (+) |
| BCMA | 12943 | CD8SP-BCMA-huC13-F12-vL-[hTCRb-S57C]-F-P2A-SP-BCMA-huC13-F12-vH-[hTCRa-T48C] | | L363 (+), U266 (+), Raji(+), Nalm6 (+) |

TABLE 14-continued

| Target | SEQ ID NO | Constructs Name | NFAT-GFP ASSAY Positive Cell lines | T-CELL Cytotoxicity Assay Positive cell line |
|---|---|---|---|---|
| BCMA | 13102 | CD8SP-BCMA-mJ22-9-vL-[hTCRb-S57C]-F-P2A-SP-BCMA-mJ22-9-vH-[hTCRa-T48C] | L363 (+), U266 (+), Raji(+), Nalm6 (+/−), Daudi (+) | L363 (+), U266 (+) |
| BCMA | 12996 | CD8SP-BCMA-huJ22-10-vL-[hTCRb-S57C]-F-P2A-SP-BCMA-huJ22-10-vH-[hTCRa-T48C] | L363 (+), U266 (+), Raji(+), Nalm6 (+/−), Daudi (+) | L363 (+), U266 (+) |
| BCMA | 12807 | CD8SP-BCMA-hu72-vL-Gly-Ser-Linker-BCMA-hu72-vH-Myc-CD8TM-BBz | RAJI (2.5+), L363 (2.5+), U266 (3+) | |
| BCMA | 12837 | CD8SP-BCMA-hu72-vL-[hTCRb-S57C]-F-P2A-SP-BCMA-hu72-vH-[hTCRa-T48C] | RAJI (3+), L363 (4+), U266 (4+) | |
| BCMA | 12839 | CD8SP-BCMA-hu72-vL-[hTCRa-T48C]-F-P2A-SP-BCMA-hu72-vH-[hTCRa-S57C] | RAJI (3+), L363 (4+), U266 (2.5+) | |
| CD19 | 895 | CD8SP-hu-CAT18-1-HL-vL-[hTCRb-KACIAH]-F-P2A-SP-hu-CAT18-1-HL-vH-[hTCRa-CSDVP]-F-F2A-PAC | RAJI (2+), Nalm6 (2+) | RAJI (+), Nalm6 (+) |
| CD19 | 846 | CD8SP-hCD19-CAT17-HL-vL-[hTCRb-KACIAH]-F-P2A-SP-hCD19-CAT17-HL-vH-[hTCRa-CSDVP]-F-F2A-PAC | RAJI (2+), Nalm6 (2+) | RAJI (+), Nalm6 (+) |
| CD19 | 16328 | CD8SP-huCD19-mROO5-1-(vL-vH)-CD3e-ECDTMCP-opt2-T2A-PAC | RAJI (2+), NALM6 (2+) | |
| CD19 | 16239 | CD8SP-huCD19-mROO5-1-(vL-vH)-CD3d-ECDTMCP-opt2-T2A-PAC | RAJI (+), NALM6 (+) | |
| CD19 | 16317 | CD8SP-CD19-hu-mROO5-1-Mlu-CD8TM-BBZ | RAJI (1.5+), NALM6 (1.5+) | RAJI (+), Naim 6(+) |
| CD19 | 14057 | CD8SP-huCD19-mROO5-1-vL-[hTCRb-S57C]-F-P2A-SP-huCD19-mROO5-1-vH-[hTCRa-T48C]-F-F2A-K13-opt | RAJI(2+), NALM6(4+) | RAJI (+), Nalm6 (+) |
| CD19 | 14056 | CD8SP-huCD19-mROO5-1-vL-[hTCRb-S57C]-F-P2A-SP-huCD19-mROO5-1-vH-[hTCRa-T48C] | RAJI(2+), NALM6(3+) | RAJI (+), Nalm6 (+) |
| CD19 | 16318 | CD8SP-huCD19-mROO5-1-vL-[hTCRb-KACIAH]-F-P2A-SP-huCD19-mROO5-1-vH-[hTCRa-CSDVP]-F-F2A-K13-opt | RAJI(+), NALM6(2+) | RAJI (+), Naim 6(+) |
| CD19 | 16311 | CD8SP-FMC63-BBz | | RAJI (+), Naim 6(+) |
| CD19 | 14035 | CD8SP-huCD19-mROO5-1-vL-[hTCRb-KACIAH]-F-P2A-SP-huCD19-mROO5-1-vH-[hTCRa-CSDVP]-F-F2A-PAC | | RAJI(+), NALM6(+) |
| CD19 | 16317 | CD8SP-CD19-hu-mROO5-1-Mlu-CD8TM-BBZ | | RAJI(+), NALM6(+), Bv173(+), Rec1(+) |
| CD19 | 16311 | CD8SP-FMC63-BBz | | RAJI(+), NALM6(+), Bv173(+), Rec1(+) |
| CD19 | 8651 | CD8SP-hu-Bul3-vL-Gly-Ser-Linker-hu-Bul3-vH-Myc-CD8TM-BBz | | RAJI(+), NALM6(+), Bv173(+), Rec1 (+) |

TABLE 14-continued

| Target | SEQ ID NO | Constructs Name | NFAT-GFP ASSAY Positive Cell lines | T-CELL Cytotoxicity Assay Positive cell line |
|---|---|---|---|---|
| CD19-Nemo | | CD8SP-CD19-hu-mROO5-1-Mlu-CD8TM-Asc-hCD3z-xba-P2A-Bam-hNEMO-D23V-K277A | | RAJI(+), NALM6(+), Bv173(+), Rec1(+) |
| CD19-K13 | 16318 | CD8SP-huCD19-mROO5-1-vL-[hTCRb-KACIAH]-F-P2A-SP-huCD19-mROO5-1-vH-[hTCRa-CSDVP]-F-F2A-K13-opt | | RAJI(+), NALM6(+) |
| CD19-MC159L | | CD8SP-huCD19-mROO5-1-vL-[hTCRb-KACIAH]-F-P2A-SP-huCD19-mROO5-1-vH-[hTCRa-CSDVP]-F-F2A-MC159 | | RAJI (+), Nalm6 (+) |
| CD19 | 14035 | CD8SP-huCD19-mROO5-1-vL-[hTCRb-KACIAH]-F-P2A-SP-huCD19-mROO5-1-vH-[hTCRa-CSDVP]-F-F2A-PAC | | RAJI (+), Nalm6 (+) |
| CD19 | 16318 | CD8SP-CD19-hu-mROO5-1-vL-Xho-[hTCRb-KACIAH]-F-P2A-SP-Bst-CD19-hu-mROO5-1-vH-Mlu-[hTCRa-CSDVP]-F-F2A-Xba-Bam-SynthK13 | | RAJI (+), Nalm 6(+) |
| CD19 | 14109 | CD8SP-huCD19-USC3-vL-[hTCRb-S57C]-F-P2A-SP-huCD19-USC3-vH-[hTCRa-T48C] | Raji (2.5+), Nalm6 (2.5+), Daudi (2.5+) | |
| CD22 | 13284 | CD8SP-CD22-h10F4v2-vL-Gly-Ser-Linker-CD22-h10F4v2-vH-MYC-CD8TM-BBZ-T2A-PA | RAJI (5+), Nalm6 (3+) | |
| CD22 | 13293 | CD8SP-CD22-h10F4v2-vL-[hTCRb-KACIAH]-F-P2A-SP-CD22-h10F4v2-vH-[hTCRa-CSDVP]-F-F2A-PAC | RAJI (6+), Nalm6 (5+) | |
| CD22 | 13349 | CD8SP-CD22-HA22-vL-[hTCRb-KAC-ECD-Bam-CD3zECDTMCP-opt]-F-P2A-SP-CD22-HA22-vH-[hTCRa-CSDVP-ECD-Kpn-CD3zECDTMCP-opt2] | RAJI (2+), Nalm6 (+/-) | |
| CD22 | 13314 | CD8SP-CD22-h10F4v2-vL-[hTCRb-S57C]-F-P2A-SP-CD22-h10F4v2-vH-[hTCRa-T48C] | RAJI (4.5+), Nalm6 (+/-) | |
| CD22 | 13320 | CD8SP-V5-[hTCRb-KACIAH]-F-P2A-CD8SP-CD22-HA22-vL-Gly-Ser-Linker-CD22-HA22-vH-Myc-[hTCRa-CSDVP]-F-F2A-PAC | RAJI (+) | |
| CD22 | 13321 | CD8SP-V5-[hTCRb-KACIAH]-F-P2A-CD8SP-CD22-HA22-vL-Gly-Ser-Linker-CD22-HA22-vH-Myc4-[preTCRa-Del48]-F-F2A-PAC | RAJI (+/-) | |
| CD22 | | CD8SP-SC22-HA22-Mlu-CD8TM-BBZ | | RAJI(+), Nalm6 (+) |
| CD22 | 13346 | CD8SP-CD22-HA22-vL-[hTCRb-KACIAH]-F-P2A-SP-CD22-HA22-vH-[hTCRa-CSDVP]-F-F2A-PAC | | RAJI(+), Nalm6 (+) |
| CD22 | 13369 | CD8SP-CD22-HA22-vL-[hTCRa-T48C]-F-P2A-SP-CD22-HA22-vH-[hTCRa-S57C] | | RAJI(+), Daudi (+) |
| CD22 | | CD22-h10F4v2-Mlu-CD8TM-BBZ | | RAJI(+), Daudi (+) |
| CD22 | 13316 | CD8SP-CD22-h10F4v2-vL-[hTCRa-T48C]-F-P2A-SP-CD22-h10F4v2-vH-[hTCRa-S57C] | | RAJI(+), Daudi (+) |
| CD22 | 14215 | CD8SP-hu-RFB4-vL-[hTCRb-S57C]-F-P2A-SP-hu-RFB4-vH-[hTCRa-T48C] | Raji (1.5+), Nalm6 (+), Daudi (2+) | Raji (+) |
| CD22 | 13343 | CD8SP-CD22-INO-vL-Gly-Ser-Linker-CD22-INO-vH-Myc-CD8TM-BBz | | Raji (+) |
| CD22 | 16319 | CD8SP-CD22-INO-vL-[hTCRb-S57C]-F-P2A-SP-CD22-INO-yH-[hTCRa-T48C]-F-F2A-PAC | Raji (+), Nalm6 (+), Daudi(+) | |

TABLE 14-continued

| Target | SEQ ID NO | Constructs Name | NFAT-GFP ASSAY Positive Cell lines | T-CELL Cytotoxicity Assay Positive cell line |
|---|---|---|---|---|
| CD22 | 16320 | CD8SP-CD22-hu-HA22-2-vL-[hTCRa-T48C]-F-P2A-SP-CD22-hu-HA22-2-vH-[hTCRa-S57C]-F-F2A-Pac | Raji (2+), Nalm6 (+), Daudi (2.5+) | |
| CD22 | 16321 | CD8SP-CD22-Med-12C5-HL-vH-[hTCRb-S57C]-F-P2A-SP-CD22-Med-12C5-HL-vL-[hTCRa-T48C]-F-F2A-PAC | Raji (+), Nalm6 (+/−), Daudi (1.5+) | |
| CD22 | 16322 | CD8SP-huRFB4-vL-Xho-[hTCRp-S57C]-F-P2A-SP-Bst-huRFB4-vH-Mlu-[hTCRa-T48C-opt]-F-F2A-Xba-PAC | RAJI (2+), NALM6 (+), Daudi (3+) | |
| CD22 | 16323 | CD8SP-CD22-CELL7-vL-[hTCRb-S57C]-F-P2A-SP-CD22-CELL7-vH-[hTCRa-T48C]-F-F2A-PAC | RAJI (+/−) | |
| CD22 | 16324 | CD8SP-CD22-HA22-vL-[hTCRb-S57C]-F-P2A-SP-CD22-HA22-vH-[hTCRa-T48C]-F-F2A-PAC | RAJI (+), NALM6 (+/−), Daudi (1.5+) | |
| CLDN6 | 1526 | CD8SP-CLDN6-USC2-LH4-vL-[hTCRa-CSDVP]-F-F2A-SP-CLDN6-USC2-LH4-vH-[hTCRb-KACIAH]-F-P2A-Xba-PAC | HepG2(3+), OVCAR3 (+) | |
| DLL3 | 1622 | CD8SP-DLL3-AM14-HL-vH-Gly-Ser-Linker-vL-Myc-CD8TM-BBz | LAN5 (+), SKMEL 37 (+/−) | |
| Her3 | 2506 | CD8SP-Her3-USC1-HL4-aL-[hTCRa-CSDVP]-F-F2A-SP-Her3-USC1-HL4-vH-[hTCRb-KACIAH]-F-P2A-Xba-PAC | MCF7(2+) | |
| MPL | | CD8SP-MPL-161-(vL-vH)-Mlu-CD8TM-BBZ-ter-Sal-WPRE-G02 | | HEL (+) |
| MPL | 16315 | CD8SP-MPL-hu-161-2-BBz | HEL (+) | HEL (+) |
| MPL | 13764 | CD8SP-hu-161-2-vL-[hTCRa-CSDVP]-F-F2A-SP-hu-161-2-vH-[hTCRb-KACIAH]-F-P2A-Xba-PAC | | HEL (+) |
| MPL | 13791 | CD8SP-hu-161-2-vL-[hTCRb-S57C]-F-P2A-SP-hu-161-2-vH-[hTCRa-T48C] | HEL (3+) | HEL (+) |
| MPL | | CD8SP-161-vL-[hTCRb-S57C]-F-P2A-IgHSP-Bst-161-vH-[hTCRa-T48C-opt]- | | HEL (+) |
| MSLN | 2749 | CD8SP-MSLN-3-HL-AM-vH-Gly-Ser-Linker-vL-Myc-CD8TM-BBz | SKOV3 (+) | |
| MSLN | 2847 | CD8SP-MSLN-237-HL-vH-Gly-Ser-Linker-vL-Myc-CD8TM-BBz | SKOV3 (+) | |
| MSLN | 9444 | CD8SP-MSLN-hu22A10-vL-[hTCRb-KACIAH]-F-P2A-SP-MSLN-hu22A10-vH-[hTCRa-CSDVP]-F-F2A-PAC | SKOV3 (+) | SKOV3 (+) |
| MSLN | 9395 | CD8SP-MSLN-7D9-v3-vL-[hTCRb-KACIAH]-F-P2A-SP-MSLN-7D9-v3-vH-[hTCRa-CSDVP]-F-F2A-PAC | SKOV3 (+) | SKOV3 (+) |
| MSLN | 14321 | CD8SP-MSLN-7D9-HL-vH-[hTCRb-S57C]-F-P2A-SP-MSLN-7D9-HL-vL-[hTCRa-T48C] | SKOV3 (+/−) | SKOV3 (+) |
| MSLN | | CD8SP-MSLN-hu22A10-vL-Xho-[hTCRβ-KACIAH]-F-P2A-SP-Bst-MSLN-hu22A10-vH-Mlu-[hTCRa-CSDVP]-F-F2A-Xba-Bam-SynthK13 | SKOV3 (+) | SKOV3 (+) |
| MSLN | | CD8SP-MSLN-7D9-vH-Xho-[hTCRβ-KACIAH]-F-P2A-SP-Bst-MSLN-7D9-vL-Mlu-[hTCRa-CSDVP]-F-F2A-Xba-Bam-SynthK13 | SKOV3 (+) | SKOV3 (+) |
| MSLN | 14294 | CD8SP-MSLN-7D9-HL-vH-[hTCRa-CSDVP]-F-F2A-SP-MSLN-7D9-HL-vL-[hTCRb-KACIAH]-F-P2A-Xba-PAC | SKOV3 (+/−) | SKOV3 (+) |

TABLE 14-continued

| Target | SEQ ID NO | Constructs Name | NFAT-GFP ASSAY Positive Cell lines | T-CELL Cytotoxicity Assay Positive cell line |
|---|---|---|---|---|
| MSLN | 14241 | CD8SP-MSLN-5-HL-vH-[hTCRa-CSDVP]-F-F2A-SP-MSLN-5-HL-vL-[hTCRb-KACIAH]-F-P2A-Xba-PAC | SKOV3 (+) | SKOV3 (+) |
| MSLN | | CD8SP-MSLN-hu22A10-vL-Xho-[hTCRa-CSDVP]-F-F2A-IgHSP-Bst-MSLN-hu22A10-vH-Mlu-[hTCRb-KACIAH]- | | SKOV3 (+) |
| MSLN | 2847 | MSLN-237-BBZ | | SKOV3 (+) |
| MSLN | 16312 | CD8SP-MSLN-hu22A10-BBz | SKOV-3 +/- | SKOV3 (+) |
| MSLN | 16313 | CD8SP-MSLN-7D9-HL-BBz | SKOV-3 +/- | SKOV3 (+) |
| MSLN | 16314 | CD8SP-MSLN-5-HL-BBz | SKOV-3 | SKOV3 (+) |
| MSLN | 2849 | CD8SP-MSLN-237-HL-vL-[hTCRa-CSDVP]-F-F2A-SP-MSLN-237-HL-vH-[hTCRb-KACIAH]-F-P2A-Xba-PAC | | SKOV3 (+) |
| MSLN | 14348 | CD8SP-MSLN-hu22A10-vL-PG4SP-v2-[hTCRb-KACIAH]-F-P2A-SP-MSLN-hu22A10-vH-PG4SP-[hTCRa-CSDVP]-F-F2A-PAC | SKOV-3 +/- | |
| MSLN | 14295 | CD8SP-MSLN-7D9-HL-vH-PG4SP-v2-[hTCRb-KACIAH]-F-P2A-SP-MSLN-7D9-HL-vL-PG4SP-[hTCRa-CSDVP]-F-F2A-PAC | SKOV-3 + | |
| MSLN | 14268 | CD8SP-MSLN-5-HL-vH-[hTCRb-S57C]-F-P2A-SP-MSLN-5-HL-vL-[hTCRa-T48C] | SKOV-3 + | SKOV3 (+) |
| MSLN | 14274 | CD8SP-V5-[hTCRb-KACIAH]-F-P2A-CD8SP-MSLN-7D9-HL-vH-Glv-Ser-Linker-MSLN-7D9-HL-vL-Myc-[hTCRa-CSDVP]-F-F2A-PAC | SKOV-3 + | |
| SLC34A2 | 3584 | CD8SP-huMX35-LH4-vL-[hTCRa-CSDVP]-F-F2A-SP-huMX35-LH4-vH-[hTCRb-KACIAH]-F-P2A-Xba-PAC | OVCAR3 (3+) | |

Comparative analysis of CD19 CARs with different antigen binding domains T cells are infected with CARs containing different antigen binding domains but having similar backbone. T cells expressing the CARs on the 2$^{nd}$ generation CAR backbone (e.g., SEQ ID NO: 16317) and double chain SIR backbone (e.g., SEQ ID NO: 14056 and 14109) and containing the antigen binding domains (e.g., vL and vH fragments, vL-CDR1-3 and vH-CDR-1-3) derived from huCD19-mROO5-1 (SEQ ID NO:14406 and 14437) and huCD19-USC3 (SEQ ID NO: 14400 and 14431), respectively, show superior in vitro cytotoxicity and cytokine secretion as compared to T cells expressing the corresponding CAR containing the antigen binding domains (e.g., vL and vH fragments) derived from hu-CD19-USC1-LH4 (SEQ ID NO: 4190 and 4264), CD19-9B7 (SEQ ID NO: 4151 and 4225) and hu-Bu-13 (SEQ ID NO: 9655 and 9686). Therefore, antigen binding domains derived from hu-CD19-USC1-LH4, CD19-9B7 and hu-Bu-13 were not selected for construction of CARs (e.g., 2$^{nd}$ generation CARs, SIR, Ab-TCR, TFP etc.)

Figure 2A:
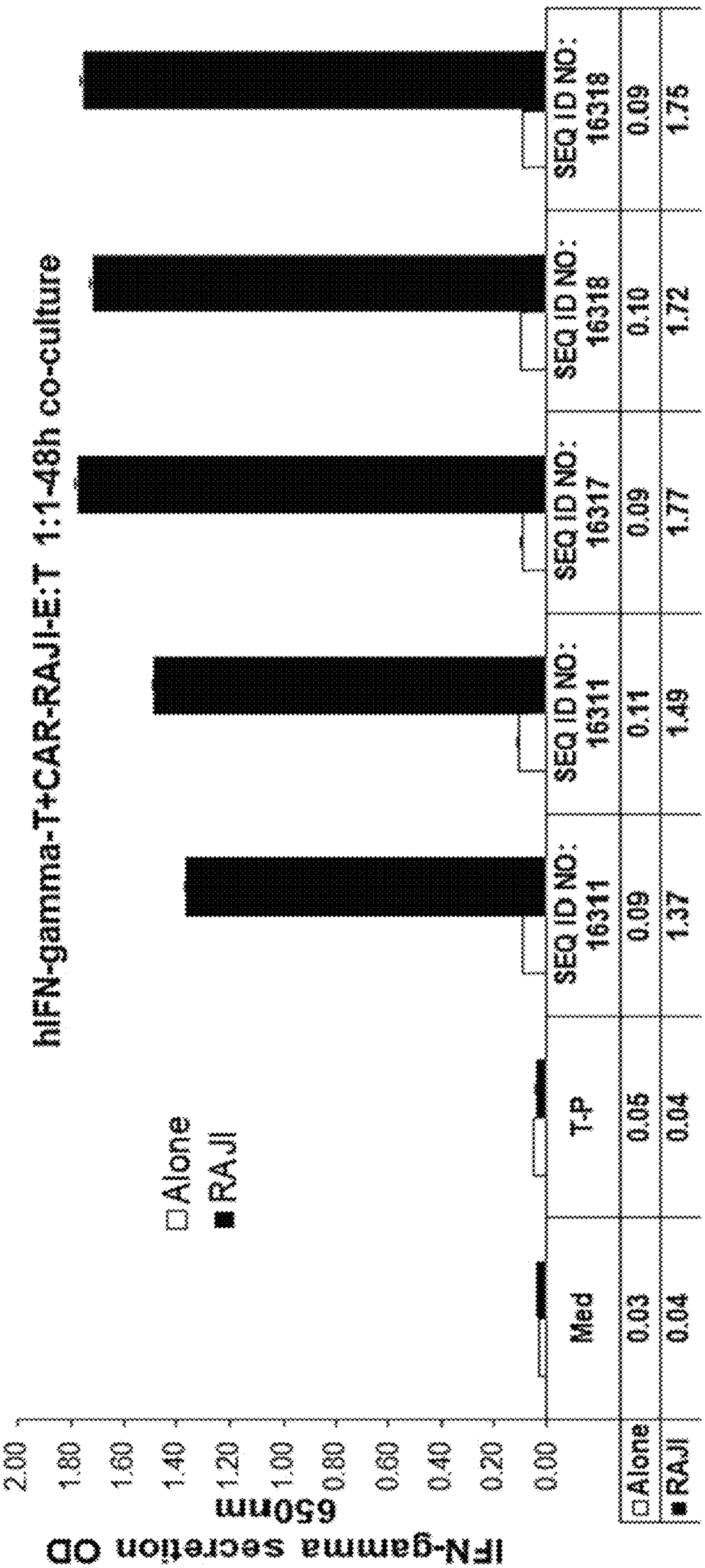
FIG. 2A-B depicts induction of IFNγ upon co-culture of CAR-T cells of the disclosure with RAJI cells (FIG. 2A) and Nalm6 cells (FIG. 2B).
Figure 2B:
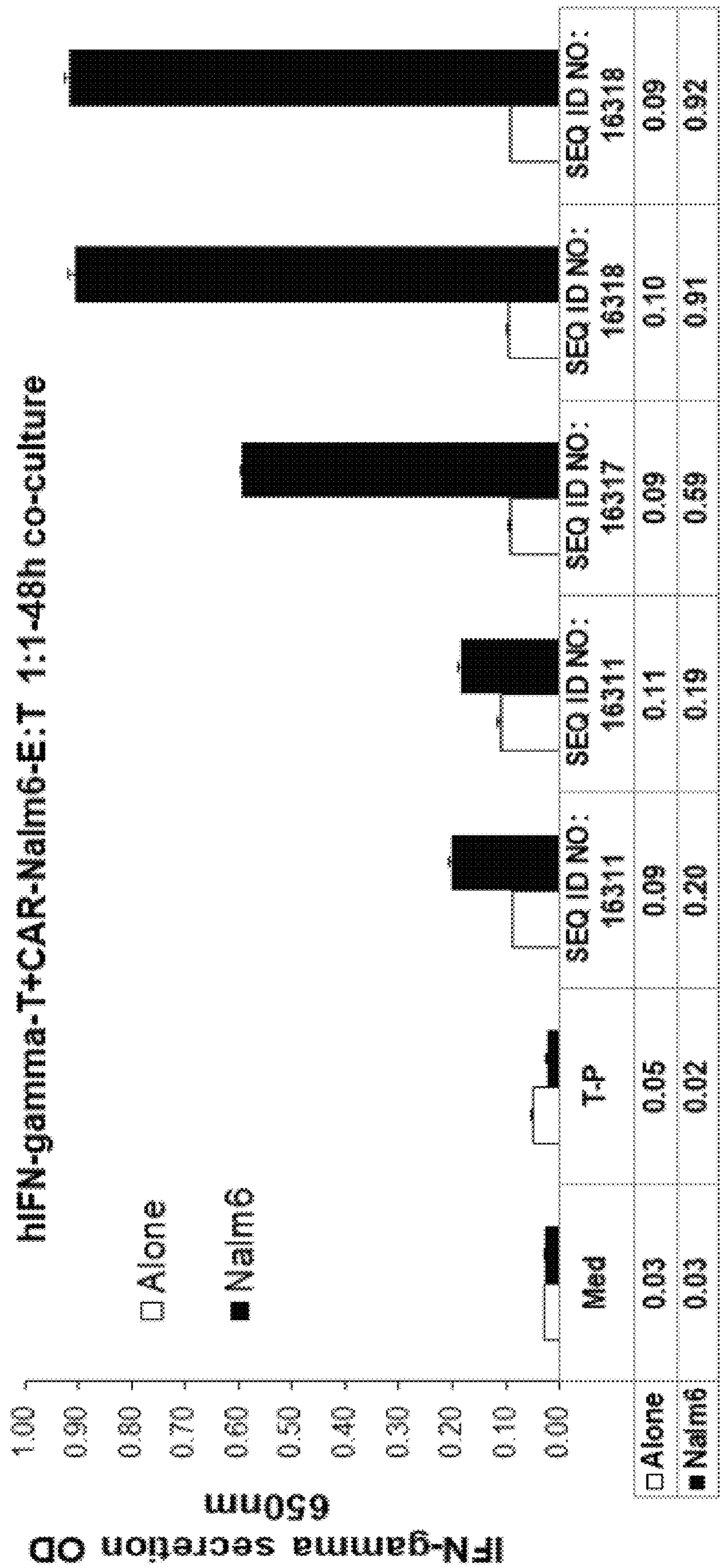
Figure 3:
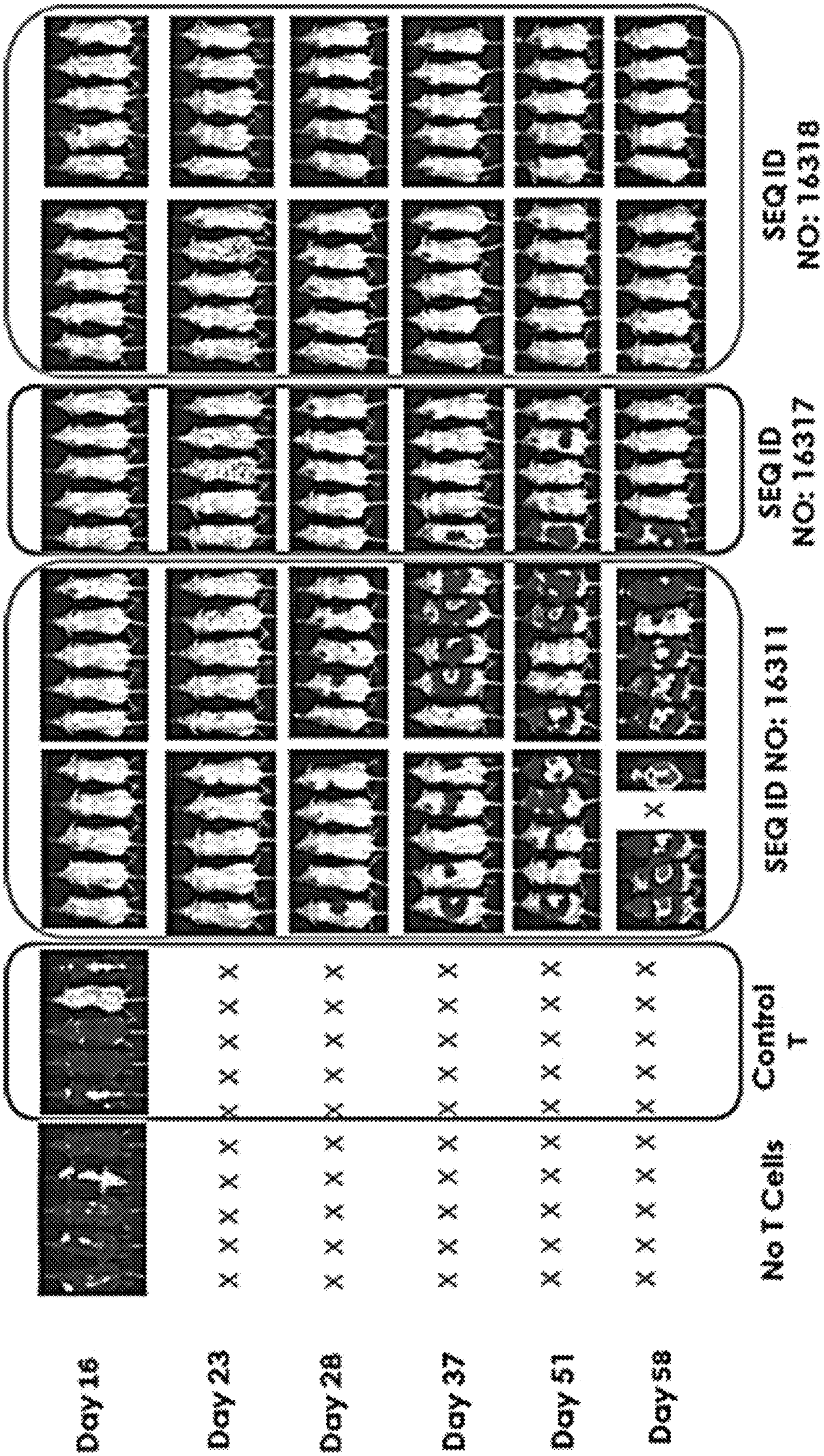
FIG. 3 depicts the in vivo efficacy of CAR-T cells of the disclosure in a xenograft model of RAJI cells as measured using bioluminescence imaging.

In vitro and in vivo studies with CD19 CAR-T cells Human peripheral blood T cells isolated using CD3 magnetic beads were infected with lentiviruses expressing the CAR constructs (SEQ ID NO: 16311, 16317 and 16318) targeting CD19. The amino acid sequences of these CARs are represented by SEQ ID NO: 16335, 16341 and 16342, respectively. The CAR represented by SEQ ID NO; 16311 is a second generation CAR with antigen binding domain derived form FMC63 antibody and contains a 41BB co-stimulatory domain and a CD3z activation domain. The CAR represented by SEQ ID NO: 16317 is a second generation CAR with antigen binding domain derived form a low affinity humanized anti-CD19 antibody and contains a 41BB co-stimulatory domain and a CD3z activation domain. In contrast, the CAR represented by SEQ ID NO: 16318 is a double chain SIR containing the antigen binding domain derived from a humanized low affinity anti-CD19 antibody. This SIR construct also expressed an accessory module encoding a codon optimized version of vFLIP-K13 (SEQ ID NO: 12734). All the CAR constructs were cloned in the pCCLc-MNDU3-WPRE vector (SEQ ID NO: 12639). CAR-T cells were expanded in vitro for 21 days in XVIVO medium supplemented with recombinant IL2 and CD3/CD28 beads. Staining with APC-conjugated Protein L followed by flow cytometry on day 5 after infection revealed strong expression of CAR constructs SEQ ID NO: 16311 and SEQ ID NO: 16317 on cell surface with approximately 45-50% of cells showing Protein L staining. In contrast, very little cell surface expression of CAR represented by SEQ ID NO: 16318 was seen with less than 2% of cell showing surface staining with Protein L. After 3 weeks in culture, RAJI and NALM cells stably expressing GLuc were cocultured with T cells expressing the different CARs at an Effector:Target (E:T) ratio of 1:1 for 48 hours. Supernatant was collected and used for measurement of IFNγ by ELISA. FIG. 2A shows significant increase in IFNγ production when all CAR-T cells are co-cultured with RAJI cells that express high level of CD19. FIG. 2B shows that CAR-T expressing the construct SEQ ID NO:16318 shows higher IFNγ induction as compared to CAR-T expressing the construct SEQ ID NO: 16311 when co-cultured with Nalm6 cells that express modest levels of CD19. Essentially similar results were obtained when the experiment is repeated to measure TNFa production. To test the in vivo efficacy of the different CAR-T cells, NSG mice were injected via tail vein with $0.5\times10^6$ RAJI cells stably expressing firefly luciferase (RAJI-Luc) and three days later injected with $4\times10^6$ T cells expressing the CAR constructs (SEQ ID NO: 16311, 16317 and 16318). Animals were imaged weekly by bioluminescence imaging following injection of D-luciferin. FIG. 3 shows that there was significant tumor growth in animals given no T cells or control T cells and they all died by day 23. The animals given T cells expressing SEQ ID NO: 16311and 16317 initially cleared the disease but showed disease relapse after day 28. In contrast, animals given T cells expressing CAR with SEQ ID NO; 16318 remained disease-free until day 51. Mice given T cells expressing CAR with SEQ ID NO; 16318 had improved survival as compared to mice given no T cells, control T cells or T cells expressing SEQ ID NO: 16311. Mice given T cells expressing SEQ ID NO: 16317 had intermediate survival.

In Vitro and In Vivo Studies with CD19 CAR-T Cells

Figure 4:
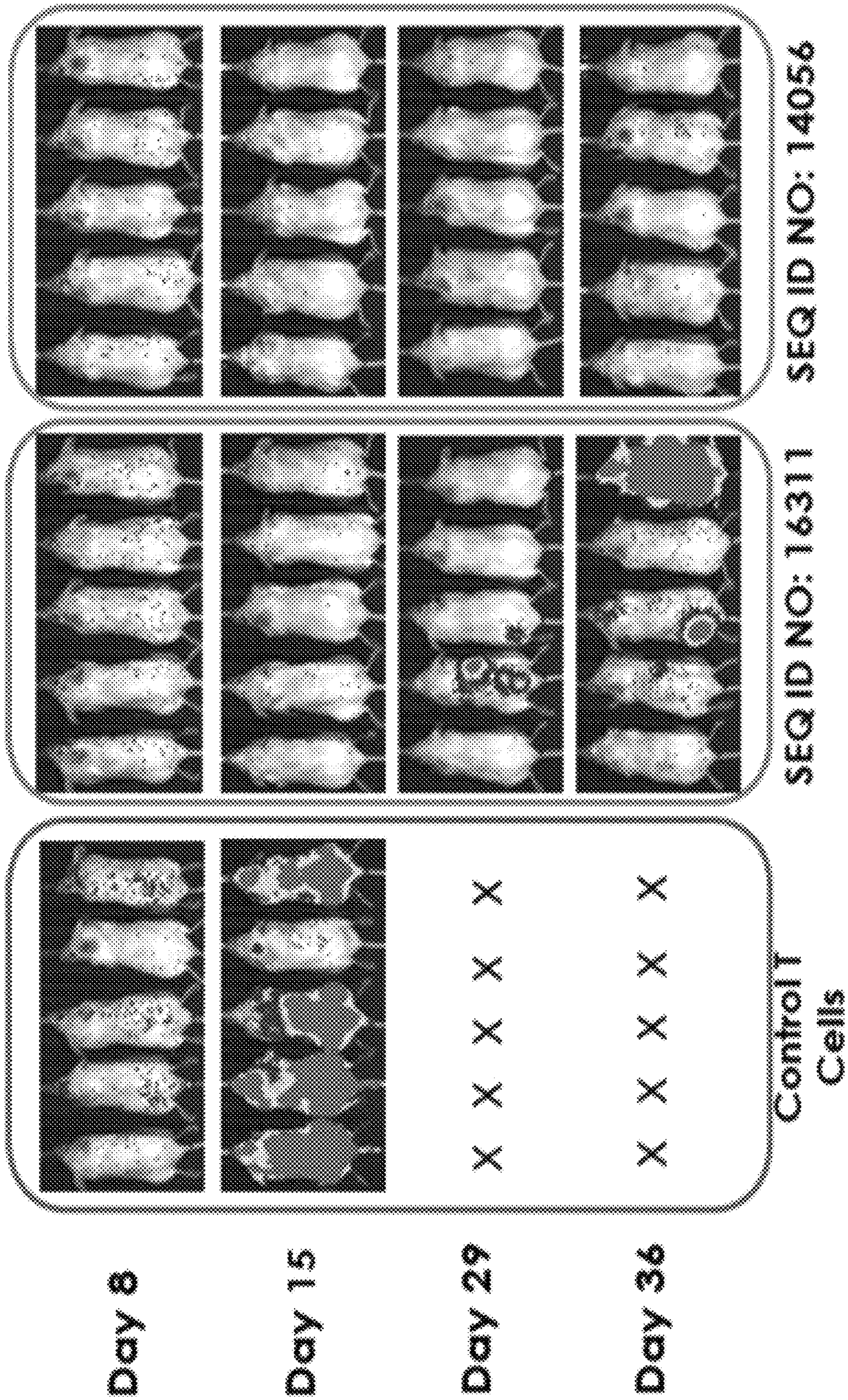
FIG. 4 depicts the in vivo efficacy of CAR-T cells of the disclosure in a xenograft model of Nalm6 cells as measured using bioluminescence imaging.

Human peripheral blood T cells isolated using CD3 magnetic beads were infected with lentiviruses expressing the CAR constructs (SEQ ID NO: 16311, and 14056) targeting CD19. The CAR represented by SEQ ID NO: 16311 has been described. In contrast, the CAR represented by SEQ ID NO: 14056 is a double chain SIR containing the antigen binding domain derived from a humanized low affinity antibody. The amino acid sequence of this construct is represented by SEQ ID NO: 15800. Both the CAR constructs were cloned in the pCCLc-MNDU3-WPRE vector (SEQ ID NO: 12639). The nucleic acid sequence of the pCCLc-MNDU3-WPRE vector encoding the CAR with SEQ ID NO: 14056 is represented by SEQ ID NO: 12641. CAR-T cells were expanded in vitro. Staining with APC-conjugated Protein L followed by flow cytometry on day 6 after infection revealed strong expression of CAR constructs SEQ ID NO: 16311 on cell surface with approximately 71.07% of cells showing Protein L staining. In contrast, less cell surface expression of CAR represented by SEQ ID NO: 14056 was seen with 22.04% of cell showing surface staining with Protein L. After approximately 1 week expansion, RAJI and NALM cells stably expressing GLuc were cocultured with T cells expressing the different CARs at an E:T ratio of 1:1 for 48 hours. Supernatant was collected and used for measurement of IFNγ, TNFa and IL2 by ELISA. T cells expressing the next generation CAR (i.e., double chain SIR) represented by SEQ ID NO: 14056 showed robust production of IFNγ, TNFα and IL2 when co-cultured with RAJI cells while the T cells expressing the FMC63-BBz CAR (SEQ ID NO: 16311) showed weak induction of these cytokines. The experiment was repeated after 4 weeks expansion of CAR-T cells in culture in XVIVO medium in the presence IL2 and CD3 and CD28 antibodies. It was observed that T cells expressing the CAR represented by SEQ ID NO: 14056 continue to show robust production of IFNγ, TNFα and IL2 when co-cultured with RAJI cells while the T cells expressing the FMC63-BBz CAR (SEQ ID NO: 16311) showed very low to negligible induction of these cytokines, suggesting evidence of functional exhaustion. To test the in vivo efficacy of the different CAR-T cells, NSG mice were injected via tail vein with $0.5\times10^6$NALM6 cells (B cell Acute Lymphocytic Leukemia) stably expressing firefly luciferase (NALM6-Luc) and three days later injected with $3\times10^6$ T cells expressing the CAR constructs (SEQ ID NO: 16311 and 14056) that had been expanded in vitro for 2-3 weeks. Animals were imaged weekly by bioluminescence imaging following injection of D-luciferin. FIG. 4 shows that there was significant tumor growth in animals given no T cells or control T cells and they all died by day 29. The animals given T cells expressing SEQ ID NO: 16311 initially cleared the disease but showed disease relapse after day 29. In contrast, animals given T cells expressing CAR with SEQ ID NO: 14056 remained disease-free until day 36. Mice given T cells expressing CAR with SEQ ID NO: 14056 had improved survival as compared to mice given no T cells, control T cells or T cells expressing CAR represented by SEQ ID NO: 16311. Essentially similar results are obtained when T cells expressing the SIR (SEQ ID NO:16330) are administered to NSG mice xenografted with Nalm6 cells.

Comparison of antigen masking by CD19 targeted CAR, SIR and TFP Accidental insertion of a conventional 2nd generation CD19 CAR into a single B cell Acute lymphocytic leukemia cell was recently shown to result to disease relapse due to masking of CD19 expressed on leukemia cells by the CAR polypeptide expressed in the leukemia cells (Ruella M et al, Nat Med. 2018 Oct. 24(10):1499-1503). This prevented the CAR-T cells from recognizing and killing the leukemia cells expressing the CAR, leading to clonal proliferation, disease relapse and death of the patient. To test, whether the next generation CAR are also susceptible to this problem, lentiviruses encoding second generation CARs (SEQ ID NO: 16311, 16317), SIRs (SEQ ID NO: 14035, 14056, 14065, 14109 and 16330) and TFP (SEQ ID NO: 16328 and 14098) are stably expressed in CD19-expressing RAJI and Nalm6 cells. The CAR-expressing cells are subsequently stained with PE-conjugated CD19 antibody (e.g., FMC63-PE). It is observed that expression of second generation CARs (SEQ ID NO: 16311, 16317), and TFP (SEQ ID NO: 16328 and 14098) results in masking of CD19 on RAJI and Nalm6 cells as revealed by decrease in cell surface staining for CD19 as determined by binding with CD19-PE antibody and flow cytometry. In contrast, expression of SIRs (SEQ ID NO: 14035, 14056, 14065, 14109 and 16330) has no significant effect on expression of CD19 in RAJI and Nalm6 cells. Furthermore, RAJI cells expressing the second generation CARs (SEQ ID NO: 16311, 16317), and TFP (SEQ ID NO: 16328 and 14098) show reduced killing by T cells expressing the corresponding CAR and TFP, while RAJI cells expressing the SIRs (SEQ ID NO: 14035, 14056, 14065, 14109 and 16330) retain their susceptibility to killing by T cells expressing the corresponding SIR.

Comparison of CARs Using Cytokine Release Syndrome (CRS) Model

The ability of different CD19 CAR constructs to induce CRS was tested using a recently described mouse model (Giavridis T et al, Nature Medicine, 2018). Briefly, SCID-Biege mice were injected i.p (intraperitoneal) with 3 million Raji-pLenti-Luc cells on day 1. 30 million CAR-Ts expressing the CAR (SEQ ID NO: 16315 and 16330) were injected on day 21 (intraperitoneal). Similar to the published study (Giavridis T et al, Nature Medicine) one third of animals given the 2nd generation CAR (SEQ ID NO: 16315) died after the injection of CAR-T cells. None of the animals receiving SIR (SEQ ID NO: 16330) died. Essentially, similar results are obtained when the experiment is repeated using T cells expressing the SIR (SEQ ID NO: 14056).

Comparative analysis of MPL CARs with different antigen binding domains T cells are infected with CARs containing different antigen binding domains but having similar backbone. T cells expressing the MPL CARs on different CAR backbones (e.g., SEQ ID NO: 16315, 13761-13770, 13780-13794) and containing the antigen binding domains (e.g., vL and vH fragments, vL-CDR1-3 and vH-CDR-1-3) derived from hu-161-2 (SEQ ID NO: 14409 and 14440) and hu-161-3 (SEQ ID NO: 14402 and 14433), respectively, show superior in vitro cytotoxicity and cytokine secretion as compared to T cells expressing the corresponding CAR containing the antigen binding domains (e.g., vL and vH fragments) derived from MPL-178, MPL-12E10 and MPL-AB317 which are described in WO2019067805. Therefore, antigen binding domains derived from MPL-178, MPL-12E10 and MPL-AB317 were not selected for construction of MPL targeted CARs (e.g., 2nd generation CARs, SIR, Ab-TCR, TFP etc.). Instead, the antigen binding domains derived form hu-161-2 (SEQ ID NO: 14409 and 14440) and hu-161-3 (SEQ ID NO: 14402 and 14433) and vL and vH containing their corresponding CDR regions were selected for MPL targeted CARs (e.g., 2nd generation CARs, SIR, Ab-TCR, TFP etc.). The CARs with SEQ ID NO: 13791 and 13793 are compared and CAR with SEQ ID NO: 13791 is shown to exhibit superior in vitro cytotoxicity and cytokine production as compared to CAR with SEQ ID NO; 13793. The CARs with SEQ ID NO: 13791 is also found to be superior to the corresponding CAR on the same backbone but containing antigen binding domain derived from murine MPL-161 as described in WO2019067805.

In Vitro and In Vivo Studies with MPL CAR-T Cells

Human peripheral blood T cells isolated using CD3 magnetic beads were infected with lentiviruses expressing the CAR constructs (SEQ ID NO: 16315 and 13791) targeting human MPL (Thrombopoietin Receptor). The CAR (CD8SP-MPL-hu-161-2-BBz) represented by SEQ ID NO; 16315 is a second generation CAR with antigen binding domain derived form a humanized MPL antibody and contains a 41BB co-stimulatory domain and a CD3z activation domain. In contrast, the CAR represented by SEQ ID NO: 13791 is a double chain SIR containing the antigen binding domain derived from a humanized MPL antibody. Both the CAR constructs were cloned in the pCCLc-MNDU3-WPRE vector (SEQ ID NO: 12639). CAR-T cells were expanded in vitro for up to 2-4 weeks. HEL.92.1.7 cells stably expressing GLuc were cocultured with T cells expressing the different CARs at an E:T ratio of 1:1 for 48 hours. Cell death was measured using the Matador Assay. T cells expressing the next generation CAR (i.e., double chain SIR) represented by SEQ ID NO: 13791 showed robust induction of target cell death and cytokine production while the T cells expressing the MPL-hu-161-2-BBz CAR (SEQ ID NO: 16315) showed weak induction of target cell death and cytokine production. To test the in vivo efficacy of the different CAR-T cells, NSG mice were injected via tail vein with $0.5\times10^6$HEL.92.1.7 cells (Acute Myeloid Leukemia) stably expressing firefly luciferase (HEL-Luc) and three days later injected with $3\times10^6$ T cells expressing the CAR constructs (SEQ ID NO: 16315 and 13791) that had been expanded in vitro for 2-3 weeks. Mice given T cells expressing CAR with SEQ ID NO; 13791 had improved survival as compared to mice given no T cells, control T cells or T cells expressing SEQ ID NO: 16315.

Comparison of Antigen Masking by MPL Targeted CAR, SIR and TFP

HEL.92.1.7 cells are infected with lentiviruses expressing the CAR constructs (SEQ ID NO: 16315, 13780 and 13791) targeting human MPL. The effect of CAR expression on masking of MPL is determined by immunofluorescence staining with MPL antibody (1.6.1) and FACS analysis. Alternatively, the expression of unbound MPL is determined by binding with a 161-scFv-Nluc fusion protein (SEQ ID NO: 2245 as described in WO2017173403, which is incorporated herein in its entirety by reference). The 161-scFv-Nluc fusion protein contains the antigen binding domain derived from an MPL targeted antibody (1.6.1) fused to NLuc. The expression of CAR with SEQ ID NO: 16315 and 13780 in HEL.92.1.7 cells is found to result in antigen masking while expression of CAR with SEQ ID NO: 13791 does not result in significant masking of MPL.

Comparative Analysis of BCMA CARs with Different Antigen Binding Domains

T cells are infected with CARs containing different antigen binding domains but having similar backbone. T cells expressing the BCMA CARs on different CAR backbones (e.g., SEQ ID NO: 12913, 12916-12946) and containing the antigen binding domains (e.g., vL and vH fragments, vL-CDR1-3 and vH-CDR-1-3) derived from BCMA-huC13-F12 (SEQ ID NO: 14413 and 14444), BCMA-huC12A3-L3H3 (SEQ ID NO: 14414 and 14445), BCMA-J6M0 (SEQ ID NO: 14415 and 14446), BCMA-huJ22-10 (SEQ ID NO: 14398 and 14229) and BCMA-hu72 (SEQ ID NO: 14401 14432) respectively, show superior in vitro cytotoxicity and cytokine secretion. Therefore, antigen binding domains derived form the above antigen binding domains and vL and vH containing their corresponding CDR regions were selected for BCMA targeted CARs (e.g., $2^{nd}$ generation CARs, SIR, Ab-TCR, TFP etc.).

In Vitro and In Vivo Studies with BCMA CAR-T Cells

Human peripheral blood T cells isolated using CD3 magnetic beads were infected with lentiviruses expressing the CAR constructs (SEQ ID NO (DNA): 16316 and 12890, 12943) targeting human BCMA. The corresponding amino acid sequences of these constructs are represented by SEQ ID NO; 16340, 14634 and 14687). The CAR represented by SEQ ID NO; 16316 is a second generation CAR with antigen binding domain derived form a humanized MPL antibody and contains a 41BB co-stimulatory domain and a CD3z activation domain. In contrast, the CAR represented by SEQ ID NO: 12890 and 12943 are double chain SIRs. Both the CAR constructs were cloned in the pCCLc-MNDU3-WPRE vector (SEQ ID NO: 12639). The complete nucleic acid sequence of the lentiviral vector encoding the CARs SEQ ID NO: 12890 and 12943 is represented by SEQ ID NO: 14378-14385, respectively. CAR-T cells were expanded in vitro for up to 2-4 weeks. L363 cells stably expressing GLuc were cocultured with T cells expressing the different CARs at an E:T ratio of 1:1 for 48 hours. Cell death was measured using the Matador Assay. All CAR-T cells showed modest induction of target cell death and cytokine (IFNγ and TNFa) production. To test the in vivo efficacy of the different CAR-T cells, NSG mice were injected via tail vein with $0.5\times10^6$ L363 (plasma cell leukemia) stably expressing firefly luciferase (L363-Luc) and two days later injected with $2\times10^6$ T cells expressing the CAR constructs (SEQ ID NO: 16316 and 12890, 12943) that had been expanded in vitro for 2-3 weeks. Mice given T cells expressing CARs with SEQ ID NO: 16316 and 12890, 12943 had improved survival as compared to mice given control T cells. Essentially similar results are obtained using T cells expressing the CARs represented by SEQ ID NO: 13049, 12996, and 12837.

The ability of different CAR constructs to mask the BCMA antigen is tested by stably expressing the CAR constructs with SEQ ID NO (DNA): 16316 and 12890, 12943 in L363 and U266 cell lines. It is observed that stable expression of CAR 16316 results in antigen masking of BCMA while no significant antigen masking is observed upon stable expression of constructs with SEQ ID NO: 12890, 12943. Similarly, CARs with SEQ ID NO: 13049, 12996, and 12837 do not result in antigen masking when expressed in BCMA expressing L363 or U266 cells.

Comparative Analysis of Mesothelin (MSLN) CARs with Different Antigen Binding Domains T cells are infected with CARs containing different antigen binding domains but having similar backbone. T cells expressing the MSLN CARs on different CAR backbones (e.g., SEQ ID NO: 14291-14323) and containing the antigen binding domains (e.g., vL and vH fragments, vL-CDR1-3 and vH-CDR-1-3) derived from MSLN-3-HL-AM (SEQ ID NO: 4136 and 4210), MSLN-5 (SEQ ID NO: 14412 and 14443), MSLN-7D9-HL (SEQ ID NO: 14411 and 14442), and MSLN-hu22A10 (SEQ ID NO: 14410 and 14441) respectively, show superior in vitro cytotoxicity and cytokine secretion as compared to antigen binding domains derived from MSLN-HuAM15 and MSLN76923-HL. Therefore, antigen binding domains derived form MSLN-3-HL-AM (SEQ ID NO: 4136 and 4210), MSLN-5 (SEQ ID NO: 14412 and 14443), MSLN-7D9-HL (SEQ ID NO: 14411 and 14442), and MSLN-hu22A10 (SEQ ID NO: 14410 and 14441) and vL and vH containing their corresponding CDR regions were selected for MSLN targeted CARs (e.g., 2nd generation CARs, SIR, Ab-TCR, TFP etc.).

Comparative Analysis of Mesothelin (MSLN) CARs with Different Antigen Binding Domains and Backbones T cells expressing the MSLN CARs containing different antigen binding domains and on different CAR backbones (SEQ ID NO: 16312-16314; 16361-16363) were generated using gene transfer involving pCCLc-MNDU3-WPRE vector (SEQ ID NO: 12639). The CAR-expressing T cells were tested against SKOV3 cells for cytotoxicity using Matador assay and for production of cytokines. All CAR-T cells showed mild to modest cytotoxicity and varying levels of cytokine production upon co-culture with SKOV3 cells. Next, the CAR-T cells were tested in a SKOV3 xenograft model in NSG mice. For this purpose, $1\times10^6$ SKOV3-Luc cells were injected subcutaneously followed a week later by injection of intravenous injection of $3\times10^6$ CAR-expressing T cells. Tumor growth was monitored by bioluminescence imaging and tumor volume measurement. A mild to modest inhibition of tumor growth was seen in mice given T cells expressing CARs with SEQ ID NO: 16312-16314 and 16361-16362.

Next, T cells expressing the MSLN CARs containing different antigen binding domains and on different CAR backbones (SEQ ID NO: 16313-16314; 16331-16334; 14268-14269; 14321, and 14374) were generated using gene transfer involving pCCLc-MNDU3-WPRE vector (SEQ ID NO: 12639). The amino acid sequence of these CAR constructs are represented by SEQ ID NO: 16337-16338; 16354-16357; 16012-16013, 16065 and 16118, respectively. The complete nucleic acid sequence of the lentiviral vector encoding the CARs SEQ ID NO: 14374, 14321 and 14268 is represented by SEQ ID NO: 14381-14383, respectively. The CAR-expressing T cells were tested against SKOV3 cells for cytotoxicity using Matador assay and for production of cytokines. All CAR-T cells showed modest cytotoxicity and varying levels of cytokine production upon 72 hour co-culture with SKOV3 cells at an E:T ratio of 1:1. T cells expressing the CARs showed high baseline production of IFNγ and TNFα which was absent in T cells expressing the CARs 16331-16334; 14268-14269; 14321, and 14374. Next, the CAR-T cells were tested in a SKOV3 xenograft model in NSG mice. For this purpose, $1\times10^6$ SKOV3-Luc cells were injected subcutaneously followed a week later by injection of intravenous injection of $3\times10^6$ CAR-expressing T cells. Tumor growth was monitored by bioluminescence imaging and tumor volume measurement. While mice given T cells expressing CARs with SEQ ID NO: 16313-16314 failed to control tumor, mice given CARs with SEQ ID NO: 16331-16334; 14268-14269; 14321, and 14374 completely eradicated the tumor after day 18 and no measureable tumor was observed in these animal until day 67. The results were confirmed using bioluminescence imaging. This resulted in significant improvement in survival in animals given CARs with SEQ ID NO: 16331-16334; 14268-14269; 14321, and 14374.

Comparative analysis of CD22 CARs with different antigen binding domains T cells are infected with CARs containing different antigen binding domains but having similar backbone. T cells expressing the CD22 CARs on the 2nd generation CAR backbone (e.g., SEQ ID NO: 13443, 13390, 13284 and 14185) and double chain SIR backbone (e.g., SEQ ID NO: 13473, 13420, 13314 and 14215) and containing the antigen binding domains (e.g., vL and vH fragments, vL-CDR1-3 and vH-CDR-1-3) derived from CD22-INO (SEQ ID NO: 14387 and 14418), CD22-hu-HA22-2 (SEQ ID NO: 14399 and 14430) CD22-h10F4v2 (SEQ ID NO: 14407 and 14438) and CD22-hu-RFB4 (SEQ ID NO: 14396 and 14427), respectively, show superior in vitro cytotoxicity and cytokine secretion as compared to T cells expressing the corresponding CAR containing the antigen binding domains (e.g., vL and vH fragments) derived from hu-HA22-1 (SEQ ID NO: 4123 and 4197) and CD22-CELL7 (SEQ ID NO: 14390 and 14421). Therefore, antigen binding domains derived from hu-HA22-1 and CD22-CELL7 were not selected for construction of CD22 targeted CARs (e.g., 2nd generation CARs, SIR, Ab-TCR, TFP etc.). Instead, the antigen binding domains derived form CD22-INO (SEQ ID NO: 14387 and 14418), CD22-hu-HA22-2 (SEQ ID NO: 14399 and 14430) CD22-h10F4v2 (SEQ ID NO: 14407 and 14438) and CD22-hu-RFB4 (SEQ ID NO: 14396 and 14427) and vL and vH containing their corresponding CDR regions were selected for CD22 targeted CARs.

T cells expressing Folate Receptor 1 (FR1 or FOLR1) CARs induce cytotoxicity in FR1-expressing SKOV3 cells. Human peripheral blood T cells isolated using CD3 magnetic beads are infected with lentiviruses expressing the CAR constructs (SEQ ID NO: 2062-2102; 2111-2140) targeting FR1. CAR-T cells are expanded in vitro for 10-14 days. SKOV3 cells stably expressing GLuc are cocultured with T cells expressing the CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing BAFF-R CARs induce cytotoxicity in BAFF-R-expressing Jeko-1 and REC-1 cells. Human peripheral blood T cells isolated using CD3 magnetic beads are infected with lentiviruses expressing the different CAR constructs (e.g., SEQ ID NO: 13922-13953; 13848-13858, 13869-13900, 13954-13964; 13975-14006) targeting BAFF-R. CAR-T cells are expanded in vitro for 10-14 days.

Jeko-1 and REC-1 cells stably expressing hGLuc are cocultured with T cells expressing the different CARs at an E:T ratio of 10:1 for 48 hours. CAR-T cells mediated induction of lysis of target cells is assayed using the Matador assay by measurement of GLuc activity. The production of IFNγ and TNFα is determined by ELISA. The in vivo activity of the CARs is demonstrated using a Jeko-1 xenograft model in NSG mice. T cells expressing the CARs (e.g., SEQ ID NO: 13897, 13950, 14003 etc) are shown to activate T cell signaling when encountered by BAFF-R positive cells.

T cells expressing Mesothelin (MSLN) CARs induce cytotoxicity in MSLN-expressing SKOV3 cells. Human peripheral blood T cells isolated using CD3 magnetic beads are infected with lentiviruses expressing the different CAR constructs (SEQ ID NO: 2748-2777; 2797-2826; 2846-2875; 2895-2924; 2944-2973; 9386-9415; 9435-9464) targeting MSLN. CAR-T cells are expanded in vitro for 10-14 days. SKOV3 cells stably expressing hGLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing Her2 CARs induce cytotoxicity in Her2-expressing MCF7 cells. Human peripheral blood T cells isolated using CD3 magnetic beads are infected with lentiviruses expressing the CAR constructs (SEQ ID NO: 2346, 2356-2385; 2395, 2405-2434; 2444, 2454-2483; 9092-9121; 9141-9170) targeting Her2. CAR-T cells are expanded in vitro for 10-14 days. MCF7 cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing EGFRviii CARs induce cytotoxicity in EGFRviii-expressing U87MG cells. Human peripheral blood T cells isolated using CD3 magnetic beads are infected with lentiviruses expressing the CAR constructs (SEQ ID NO: 1660, 1670-1699, 1709, 1719-1748, 1758, 1768-1797, 1807, 1817-1846) targeting EGFRviii. CAR-T cells are expanded in vitro for 10-14 days. U87MG-EGFRviii cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing EMR2 CARs induce cytotoxicity in EMR2-expressing cells. Human peripheral blood T cells isolated using CD3 magnetic beads are infected with lentiviruses expressing the CAR constructs (SEQ ID NO: 1856, 1866-1895, 1905, 1915-1944, 1954, 1964-1993) targeting EMR2. CAR-T cells are expanded in vitro for 10-14 days. Molm13 cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing DLL3 CARs induce cytotoxicity in DLL3-expressing cells. Human peripheral blood T cells isolated using CD3 magnetic beads are infected with lentiviruses expressing the CAR constructs (SEQ ID NO: 1553-1650) targeting DLL3. CAR-T cells are expanded in vitro for 10-14 days. SK-MEL-37 cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing CD19 CARs induce cytotoxicity in CD19-expressing cells. Human peripheral blood T cells isolated using CD3 magnetic beads are infected with lentiviruses expressing the CAR constructs (SEQ ID NO: 769-817, 720-768, 867-915, 965-1013, 818-866, 8632-8680) targeting CD19. CAR-T cells are expanded in vitro for 10-14 days. RAJI or NALM6 cells stably expressing GLuc are cocultured with T cells expressing the different CARs at an E:T ratio of 10:1 for 4 hours. CAR-T cells mediated induction of lysis of target cells is assayed using the Matador assay by measurement of GLuc activity. The in vivo activity of the CARs is demonstrated using a xenograft model in NSG mice.

T cells expressing CD20 CARs induce cytotoxicity in CD20-expressing cells. Human peripheral blood T cells isolated using CD3 magnetic beads are infected with lentiviruses expressing the CAR constructs (SEQ ID NO:1063-1111, 1014-1062) targeting CD20. CAR-T cells are expanded in vitro for 10-14 days. RAJI or NALM6 cells stably expressing GLuc are cocultured with T cells expressing the different CARs at an E:T ratio of 10:1 for 4 hours. CAR-T cells mediated induction of lysis of target cells is assayed using the Matador assay by measurement of GLuc activity. The in vivo activity of the CARs is demonstrated using a xenograft model in NSG mice.

T cells expressing BCMA CARs induce cytotoxicity in BCMA-expressing cells. Human peripheral blood T cells isolated using CD3 magnetic beads are infected with lentiviruses expressing the CAR constructs (SEQ ID NO: 377-572, 8093-8484) targeting BCMA. CAR-T cells are expanded in vitro for 10-14 days. U266 and L363 cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing FLT3 CARs induce cytotoxicity in FLT3-expressing cells. Human peripheral blood T cells isolated using CD3 magnetic beads are infected with lentiviruses expressing the CAR constructs (SEQ ID NO: 8926-9023) targeting FLT3. CAR-T cells are expanded in vitro for 10-14 days. RS4;11 and MV4;11 cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing CLL1 CARs induce cytotoxicity in CLL1-expressing cells. Human peripheral blood T cells isolated using CD3 magnetic beads are infected with lentiviruses expressing the CAR constructs (SEQ ID NO: 8779-8876) targeting CLL1. CAR-T cells are expanded in vitro for 10-14 days. RAJI and U937 cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing BST1 CARs induce cytotoxicity in BST1-expressing cells. Human peripheral blood T cells isolated using CD3 magnetic beads are infected with lentiviruses expressing the CAR constructs (SEQ ID NO: 8485-8631) targeting BST1. CAR-T cells are expanded in vitro for 10-14 days. KG1 cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing IL1RAP CARs induce cytotoxicity in IL1RAP-expressing cells. Human peripheral blood T cells isolated using CD3 magnetic beads are infected with lentiviruses expressing the CAR constructs (SEQ ID NO: 9171-9317) targeting IL1RAP. CAR-T cells are expanded in vitro for 10-14 days. THP-1 cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing gpA33 CARs induce cytotoxicity in gpA33-expressing cells. Human peripheral blood T cells isolated using CD3 magnetic beads are infected with lentiviruses expressing the CAR constructs (SEQ ID NO: 9024-9072) targeting gpA33. CAR-T cells are expanded in vitro for 10-14 days. Molm-13 cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing GPC3 CARs induce cytotoxicity in GPC3-expressing cells. Human peripheral blood T cells isolated using CD3 magnetic beads are infected with lentiviruses expressing the CAR constructs (SEQ ID NO: 9024-9072) targeting GPC3. CAR-T cells are expanded in vitro for 10-14 days. HepG2 cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing CLDN6 CARs induce cytotoxicity in CLDN6-expressing cells. Human peripheral blood T cells isolated using CD3 magnetic beads are infected with lentiviruses expressing the CAR constructs (SEQ ID NO: 1455-1552) targeting CLDN6. CAR-T cells are expanded in vitro for 10-14 days. HepG2 cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing UPK1B CARs induce cytotoxicity in UPK1B-expressing cells. Human peripheral blood T cells isolated using CD3 magnetic beads are infected with lentiviruses expressing the CAR constructs (SEQ ID NO: 1455-1552) targeting UPK1B. CAR-T cells are expanded in vitro for 10-14 days. OVCAR-3 cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing BMPR1B CARs induce cytotoxicity in BMPR1B-expressing cells. Human peripheral blood T cells isolated using CD3 magnetic beads are infected with lentiviruses expressing the CAR constructs (SEQ ID NO: 573-670) targeting BMPR1B. CAR-T cells are expanded in vitro for 10-14 days. LNCaP and COV434 cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing WISP1 CARs induce cytotoxicity in WISP1-expressing cells. Human peripheral blood T cells isolated using CD3 magnetic beads are infected with lentiviruses expressing the CAR constructs (SEQ ID NO: 3856-3953) targeting WISP1. CAR-T cells are expanded in vitro for 10-14 days. MDA-MB-453 cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing CD133 CARs induce cytotoxicity in CD133-expressing cells. Human peripheral blood T cells isolated using CD3 magnetic beads are infected with lentiviruses expressing the CAR constructs (SEQ ID NO: 11312-11458) targeting CD133. CAR-T cells are expanded in vitro for 10-14 days. Reh and RS4;11cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing Prolactin Receptor (PRLR) CARs induce cytotoxicity in PRLR-expressing cells. Human peripheral blood T cells isolated using CD3 magnetic beads are infected with lentiviruses expressing the CAR constructs (SEQ ID NO: 3121-3218) targeting PRLR. CAR-T cells are expanded in vitro for 10-14 days. MCF7 cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing IL13Ra2 CARs induce cytotoxicity in IL13Ra2-expressing cells. Human peripheral blood T cells isolated using CD3 magnetic beads are infected with lentiviruses expressing the CAR constructs (SEQ ID NO: 14132-14165) targeting IL13Ra2. CAR-T cells are expanded in vitro for 10-14 days. U87MG cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing Nectin-4 CARs induce cytotoxicity in Nectin-4-expressing cells. Human peripheral blood T cells isolated using CD3 magnetic beads are infected with lentiviruses expressing the CAR constructs (SEQ ID NO: 3072-3120, 9465-9513) targeting Nectin-4. CAR-T cells are expanded in vitro for 10-14 days. MCF7 cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing PSMA CARs induce cytotoxicity in PSMA-expressing cells. Human peripheral blood T cells isolated using CD3 magnetic beads are infected with lentiviruses expressing the CAR constructs (SEQ ID NO: 3219-3365) targeting PSMA. CAR-T cells are expanded in vitro for 10-14 days. PC3 cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing TSHR (Thyroid Stimulating Hormone Receptor) CARs induce cytotoxicity in TSHR-expressing cells. Human peripheral blood T cells isolated using CD3 magnetic beads are infected with lentiviruses expressing the CAR constructs (SEQ ID NO: 3611-3659) targeting TSHR. CAR-T cells are expanded in vitro for 10-14 days. TT cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing CDH19 CARs induce cytotoxicity in CDH19-expressing cells. Human peripheral blood T cells isolated using CD3 magnetic beads are infected with lentiviruses expressing the CAR constructs (SEQ ID NO: 1308-1405) targeting CDH19. CAR-T cells are expanded in vitro for 10-14 days. MEL-624 cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing VISTA CARs induce cytotoxicity in VISTA-expressing cells. Human peripheral blood T cells isolated using CD3 magnetic beads are infected with lentiviruses expressing the CAR constructs (SEQ ID NO: 3758-3855) targeting VISTA. CAR-T cells are expanded in vitro for 10-14 days. MOLM-13 cells stably expressing GLuc are cocultured with T cells expressing the different CARs at an E:T ratio of 10:1 for 4 hours. CAR-T cells mediated induction of lysis of target cells is assayed using the Matador assay by measurement of GLuc activity. The in vivo activity of the CARs is demonstrated using a xenograft model in NSG mice.

T cells expressing ROR1 CARs induce cytotoxicity in ROR1-expressing cells. Human peripheral blood T cells isolated using CD3 magnetic beads are infected with lentiviruses expressing the CAR constructs (SEQ ID NO: 9514-9562) targeting ROR1. CAR-T cells are expanded in vitro for 10-14 days. JEKO-1 cells stably expressing GLuc are cocultured with T cells expressing the different CARs at an E:T ratio of 10:1 for 4 hours. CAR-T cells mediated induction of lysis of target cells is assayed using the Matador assay by measurement of GLuc activity. The in vivo activity of the CARs is demonstrated using a xenograft model in NSG mice.

T cells expressing Liv1 CARs induce cytotoxicity in Liv1-expressing cells. Human peripheral blood T cells isolated using CD3 magnetic beads are infected with lentiviruses expressing the CAR constructs (SEQ ID NO: 9514-9562) targeting Liv1. CAR-T cells are expanded in vitro for 10-14 days. MCF7 cells stably expressing GLuc are cocultured with T cells expressing the different CARs at an E:T ratio of 10:1 for 4 hours. CAR-T cells mediated induction of lysis of target cells is assayed using the Matador assay by measurement of GLuc activity. The in vivo activity of the CARs is demonstrated using a xenograft model in NSG mice.

T cells expressing Integrin B7 CARs induce cytotoxicity in Integrin B7-expressing cells. Human peripheral blood T cells isolated using CD3 magnetic beads are infected with lentiviruses expressing the CAR constructs (SEQ ID NO: 2533-2581) targeting Integrin B7. CAR-T cells are expanded in vitro for 10-14 days. U266 cells stably expressing GLuc are cocultured with T cells expressing the different CARs at an E:T ratio of 10:1 for 4 hours. CAR-T cells mediated induction of lysis of target cells is assayed using the Matador assay by measurement of GLuc activity. The in vivo activity of the CARs is demonstrated using a xenograft model in NSG mice.

T cells expressing SLC34A2 CARs induce cytotoxicity in SLC34A2-expressing cells. Human peripheral blood T cells isolated using CD3 magnetic beads are infected with lentiviruses expressing the CAR constructs (SEQ ID NO: 3562-3610) targeting SLC34A2. CAR-T cells are expanded in vitro for 10-14 days. OVCAR-3 and OVCAR-4 cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing LY6E CARs induce cytotoxicity in LY6E-expressing cells. Human peripheral blood T cells isolated using CD3 magnetic beads are infected with lentiviruses expressing the CAR constructs (SEQ ID NO: 2582-2630) targeting LY6E. CAR-T cells are expanded in vitro for 10-14 days. Molm13 cells stably expressing GLuc are cocultured with T cells expressing the different CARs at an E:T ratio of 10:1 for 4 hours. CAR-T cells mediated induction of lysis of target cells is assayed using the Matador assay by measurement of GLuc activity. The in vivo activity of the CARs is demonstrated using a xenograft model in NSG mice.

T cells expressing LYPD1 CARs induce cytotoxicity in LYPD1-expressing cells. Human peripheral blood T cells isolated using CD3 magnetic beads are infected with lentiviruses expressing the CAR constructs (SEQ ID NO: 2631-2679) targeting LYPD1. CAR-T cells are expanded in vitro for 10-14 days. OVCAR-3 cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing STEAP1 CARs induce cytotoxicity in STEAP1-expressing cells. Human peripheral blood T cells isolated using CD3 magnetic beads are infected with lentiviruses expressing the CAR constructs (SEQ ID NO: 3513-3561, 9563-9611) targeting STEAP1. CAR-T cells are expanded in vitro for 10-14 days. PC3 and LNCaP cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing Muc5Ac CARs induce cytotoxicity in Muc5Ac-expressing cells. Human peripheral blood T cells isolated using CD3 magnetic beads are infected with lentiviruses expressing the CAR constructs (SEQ ID NO: 2974-3022) targeting Muc5Ac. CAR-T cells are expanded in vitro for 10-14 days. Capan-1 (Pancreatic cancer) and NCI-H1437 cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing Muc17 CARs induce cytotoxicity in Muc17-expressing cells. Human peripheral blood T cells isolated using CD3 magnetic beads are infected with lentiviruses expressing the CAR constructs (SEQ ID NO: 3023-3071) targeting Muc17. CAR-T cells are expanded in vitro for 10-14 days. SW1463 and SW403 cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing RNF43 CARs induce cytotoxicity in RNF43-expressing cells. Human peripheral blood T cells isolated using CD3 magnetic beads are infected with lentiviruses expressing the CAR constructs (SEQ ID NO: 3366-3463) targeting RNF43. CAR-T cells are expanded in vitro for 10-14 days. Lovo cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing Robo4 CARs induce cytotoxicity in Robo4-expressing cells. Human peripheral blood T cells isolated using CD3 magnetic beads are infected with lentiviruses expressing the CAR constructs (SEQ ID NO: 3464-3512) targeting Robo4. CAR-T cells are expanded in vitro for 10-14 days. ME-1 cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing gPNMB CARs induce cytotoxicity in gPNMB-expressing cells. Human peripheral blood T cells isolated using CD3 magnetic beads are infected with lentiviruses expressing the CAR constructs (SEQ ID NO: 2239-2287) targeting gPNMB. CAR-T cells are expanded in vitro for 10-14 days. U87MG cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

T cells expressing FCRHS CARs induce cytotoxicity in FCRHS-expressing cells. Human peripheral blood T cells isolated using CD3 magnetic beads are infected with lentiviruses expressing the CAR constructs (SEQ ID NO: 1994-2042) targeting FCRHS. CAR-T cells are expanded in vitro for 10-14 days. REC-1 cells stably expressing GLuc are cocultured with T cells expressing the different CARs at an E:T ratio of 10:1 for 48 hours. CAR-T cells mediated induction of lysis of target cells is assayed using the Matador assay by measurement of GLuc activity. The in vivo activity of the CARs is demonstrated using a xenograft model in NSG mice.

In vivo efficacy of CARs targeting CD19. Human peripheral blood T cells isolated using CD3 magnetic beads are infected with lentiviruses expressing the CD19 CAR constructs (e.g., SEQ ID NO: 8633-8680). NSG mice (Jackson Lab) are sub-lethally irradiated at a dose of 175 cGy. Approximately 24 hours post irradiation (day 2), mice are injected with $2.5\times10^4$RAJI cells via tail-vein. On day 3, the mice (n=5 for each group) are treated with 5 million CD19 CAR-T cells. Control mice (n=5) receive no T cells or uninfected T cells. Mice are given human IL2 (400 IU intraperitoneally) on alternate days till the death of all mice in control group. Mice receiving the CD19 CAR-T cells survive longer than the control mice. Essentially a similar approach is used to test the in vivo efficacy of other CAR T cells of the disclosure using xenografts of cell lines expressing their target antigens as shown in Table A or using information available in the literature.

Use of CAR-T cells for adoptive cell therapy. CAR-T cells of the disclosure can be used for adoptive cell therapy. As an example, patients with relapsed Acute Lymphocytic Leukemia (ALL), Chronic Lymphocytic Leukemia (CLL), or high-risk intermediate grade B-cell lymphomas may receive immunotherapy with adoptively transferred CAR-T cells targeting CD19. A leukapheresis product collected from each patient undergoes selection of CD3-positive T lymphocytes using the CliniMACS Prodigy® System from Miltenyi Biotec and following the manufacturer's recommendations. Cells are transduced with clinical grade CD19-CAR virus (e.g., SEQ ID NO: 14056, SEQ ID NO: 14109, SEQ ID NO: 16330; SEQ ID NO:903, SEQ ID NO: 791] and then selection and expansion of the CAR-T cells occur in a closed system. After the resulting cell products have undergone quality control testing (including sterility and tumor specific cytotoxicity tests), they are cryopreserved. Meanwhile, following leukapheresis, study participants commence with lymphodepletive chemotherapy (30 mg/$m^2$/day fludarabine plus 500 mg/$m^2$/day cyclophosphamide×3 days). One day after completion of their lymphodepleting regimen, the previously stored CAR-T cell product is transported, thawed and infused at the patient's bedside. The study participant receives CAR-transduced lymphocytes infused intravenously followed by high-dose (720,000 IU/kg) IL-2 (Aldesleukin; Prometheus, San Diego, CA) every 8 hours to tolerance. The dose of CAR-T product varies from $1\times10^4$ CAR+ve CD3 cells/kg to $5\times10^9$ CAR+ve CD3 cells/kg as per the study protocol. The CAR-T product may be administered in a single infusion or split infusions.

Research participants can be pre-medicated at least 30 minutes prior to T cell infusion with 15 mg/kg of acetaminophen P.O. (max. 650 mg.) and diphenhydramine 0.5-1 mg/kg I.V. (max dose 50 mg). The study participant may optionally receive daily injections of human IL-2. Clinical and laboratory correlative follow-up studies can then be performed at the physician's discretion, and may include quantitative RT-PCR studies for the presence of CD19-expressing ALL/lymphoma cells and/or the adoptively transferred T cells; FDG-PET and/or CT scans; bone marrow examination for disease specific pathologic evaluation; lymph node biopsy; and/or long-term follow up per the guidelines set forth by the FDA's Biologic Response Modifiers Advisory Committee that apply to gene transfer studies. Essentially a similar approach can be used to treat other diseases using immune cells (e.g., T cells) that have been engineered to express the CAR of the disclosure where the CAR targets an antigen or antigens expressed on the disease causing or disease-associated cells.

Use of CAR-T cells targeting multiple antigens for adoptive cell therapy. Patients many cancers are enrolled in an IRB approved phase I clinical trial of to immunotherapy with adoptively transferred CAR-T cells targeting different disease causing or disease associated antigens. The CAR for different diseases are selected based on the known expression of their target antigen in the disease causing or disease associated cells. Where possible, the expression of the CAR target on the disease causing or disease associated cells is confirmed by binding with ABD-GGS-NLuc fusion protein in which the antigen binding domain (ABD) of CAR is fused to non-secretory form of NLuc protein via a flexible linker. Alternatively, immunohistochemistry or flow cytometry using commercially available antibodies is used to confirm the expression of the CAR target on disease causing or disease associated cells. T cells are collected from the subject using leukopheresis, transduced with the appropriate CAR encoding lentivirus vector and expanded ex vivo using CD3/CD28 beads in a closed system. After the resulting cell products have undergone quality control testing (including sterility and tumor specific cytotoxicity tests), they are cryopreserved. Meanwhile, study participants commence with lymphodepletive chemotherapy (30 $mg/m^2$/day fludarabine plus 500 $mg/m^2$/day cyclophosphamide x 3 days). One day after completion of their lymphodepleting regimen, the study participant receives CAR transduced lymphocytes infused intravenously followed by high-dose (720,000 IU/kg) IL-2 (Aldesleukin; Prometheus, San Diego, CA) every 8 hours to tolerance. The previously stored CAR-T cell product is transported, thawed and infused at the patient's bedside. The dose of CAR-T product varies from $1\times10^4$ CAR+ve CD3 cells/kg to $5\times10^9$ CAR+ve CD3 cells/kg as per the study protocol. The CAR-T product may be administered in a single infusion or split infusions. Research participants can be pre-medicated at least 30 minutes prior to T cell infusion with 15 mg/kg of acetaminophen P.O. (max. 650 mg.) and diphenhydramine 0.5-1 mg/kg I.V. (max dose 50 mg). The study participant may optionally receive daily injections of human IL-2. Clinical and laboratory correlative follow-up studies can then be performed at the physician's discretion.

Use of Both Myeloablative and Lymphodepleting Chemotherapy Prior to Adoptive Cellular Therapy Essentially a similar protocol as described in the preceding example is used with the exception that the study participant receives both myeloablative and lymphodepleting chemotherapy regimen. Exemplary myeloablative conditioning regimens include FCE (Fludarabine 25 $mg/m^2$/day, days −7 to −3; cyclophosphamide 200 $mg/m^2$/day, days −7 to −3; and etoposide 250 $mg/m^2$/day, days −4 to −3), FCIE (Fludarabine 25 $mg/m^2$/day, days −7 to −3; cyclophosphamide 200 $mg/m^2$/day, days −7 to −3; idarubicin 12 $mg/m^2$/day, days −7 to −5 and etoposide 250 $mg/m^2$/day, days −4 to −3), FluCyE (fludarabine 30 $mg/m^2$/day, cytarabine 1.5 g/m2/day administered following fludarabine and etoposide 100 $mg/m^2$/day with each of the drugs given on days −6 to −1), or FE (fludarabine 30 $mg/m^2$/day and Etoposide 100 $mg/m^2$/day on days −5 to day −1) or Etoposide (50-100 $mg/m^2$/day on days −5 to day −1). The subject receives CAR-T cell products 24-72 hours after the completion of chemotherapy. The incidence and severity of cytokine release syndrome and neurotoxicity is reduced in patients receiving both myeloablative and lymphodepleting chemotherapy prior to the administration of CAR-T cells.

Use of an mTOR inhibitor RAD001 in combination with CAR-T cells. The study is conducted as described in the preceding examples with the exception that starting 1 day after the infusion of CAR-T cells, study participants are administered an mTOR inhibitor, e.g., an allosteric inhibitor, e.g., RAD001, at a dosage that provides a target trough level 0.1 to 3 ng/ml, where the trough level" refers to the concentration of a drug in plasma just before the next dose, or the minimum drug concentration between two doses.

Use of Ibrutinib in combination with CAR-T cells. The study is conducted as described in the preceding examples with the exception that starting 1 day after the infusion of CAR-T cells, study participants are administered oral ibrutinib at dose of 140 mg/d to 420 mg/d. It is noted that the study participant receiving ibrutinib has less incidence of severe cytokine release syndrome as compared to participants who received CAR-T cells without ibrutinib.

Use of allogeneic CAR-T cells for adoptive cells therapy. Patients with relapsed myeloma and primary effusion lymphoma may receive immunotherapy with adoptively transferred allogeneic CAR-T cells. A leukapheresis product collected from an HLA-matched donor undergoes selection of CD3 positive T lymphocytes using the CliniMACS Prodigy® System from Miltenyi Biotec and following the manufacturer's recommendations. BCMA-specific CAR (SEQ ID NO: 12837, 12890, 12943 or 13049) is directed to the TRAC locus in T cells essentially as described in the study by Eyquem J et al (Nature, 543(7643):113-117). Cells are expanded for 9-12 days in a closed system. After the resulting cell products have undergone quality control testing (including sterility and tumor specific cytotoxicity tests), they are cryopreserved. Meanwhile, study participants commence with lymphodepletive chemotherapy (30 $mg/m^2$/day fludarabine plus 500 $mg/m^2$/day cyclophosphamide x 3 days). One day after completion of their lymphodepleting regimen, the study participant receives transduced lymphocytes infused intravenously followed by high-dose (720,000 IU/kg) IL-2 (Aldesleukin; Prometheus, San Diego, CA) every 8 hours to tolerance. The CAR-T cell product is transported, thawed and infused at the patient's bedside. The dose of CAR-T product may vary from $1\times10^4$ CAR+ve CD3 cells/kg to $5\times10^9$ CAR+ve CD3 cells/kg as per the study protocol. The CAR product may be administered in a single infusion or split infusions. Research participants can be pre-medicated at least 30 minutes prior to CAR-T cell infusion with 15 mg/kg of acetaminophen P.O. (max. 650 mg.) and diphenhydramine 0.5-1 mg/kg I.V. (max dose 50 mg). Use of immunosuppressive drugs is also at the discretion of the physician. Essentially a similar approach can be used to treat other diseases using allogeneic immune cells (e.g., T cells) expressing the CAR of the disclosure where the CAR targets an antigen or antigens expressed on the disease causing or disease-associated cells.

CAR-T Cell Hepatic Arterial Infusion. In addition to intravenous infusion, CAR-T cells can be infused intra-arterially to provide high concentration of CAR-T cells in a local area or organ involved with a disease. In the following example, this approach is used in case of a patient with hepatic metastases from an ovarian cancer which expresses Mesothelin (MSLN). Essentially a similar approach can be used for intra-arterial infusion of CAR-T cells targeting other tumor antigens.

A mapping angiogram is performed via a right common femoral artery approach at baseline. The gastroduodenal and right gastric arteries, in addition to other potential sources of extrahepatic perfusion, is embolized with microcoils. The same arterial access procedure is carried out for administration of T cells expressing the MSLN CARs either singly or in combination (SEQ ID NO: 16331-16334; 14268-14269; 14321, or 14374). The T cells is collected from the patient on day 0 and are infected with CAR encoding lentiviruses either singly or in combination and expanded as described in the previous examples. The CAR-T cells will be given in a dose escalating fashion on day 14 ($10^8$ CAR-T cells), day 28 ($10^9$ CAR-T cells) and day 44 ($10^{10}$ CAR-T cells). The CAR-T cells are injected manually via a 60 cc syringe at a rate of <2 cc/second. The total volume of infusion is approximately 100 cc. Angiography with calibrated contrast rate is performed after the first infusion of 50 cc and at completion of the CAR-T infusion to confirm preserved arterial flow. Infusions are delivered into the proper hepatic artery when possible. Certain patients have aberrant hepatic arterial anatomy, where either the right or left hepatic artery does not arise from the proper hepatic artery. In such cases the dose of CAR-T cells is split based upon lobar volume calculations. In such cases, split doses are delivered separately into the right and left hepatic arteries to ensure proportionate CAR-T delivery to both hepatic lobes. Clinical assessments are performed at baseline, on infusion days, and 1, 2, 4, and 7 days post-infusion.

Intraperitoneal administration of CAR-T cells. CAR-T cells can also be administered intraperitoneally, essentially as described in Koneru M et al (Journal of Translational Medicine; 2015; 13:102). In the following example, this approach is used in case patients with peritoneal involvement with ovarian cancer which expresses Folate Receptor alpha (FR1 or FOLR1). Essentially a similar approach can be used for intra-peritoneal infusion of CAR-T cells targeting other tumor antigens.

A screening informed consent will be offered to patients with recurrent high-grade serous ovarian cancer to test their cancer for the expression of FR1 (FOLR1). In case the expression of FR1 is confirmed by immunohistochemistry, then patients will have a leukapheresis product obtained from peripheral blood. In the treatment phase of the study, the leukapheresis product will be thawed and washed. Subsequently, CD3+ T cells will be isolated from the thawed leukapheresis product by magnetic separation using CD3/CD28 beads. Activated T cells will be lentivirally transduced with a FOLR1 CAR [SEQ ID NO: 2120 or 2121] and further expanded using CD3/CD28 bead expansion protocol.

These autologous T cells will be genetically engineered to express the FOLR1 CAR [SEQ ID NO: 2120 or 2121]. Patients with recurrent high-grade serous ovarian, primary peritoneal or fallopian tube carcinoma shown to express FR1 antigen confirmed by immunohistochemistry (IHC) analysis of banked (paraffin embedded) or freshly biopsied tumor will potentially be eligible for the study.

Cohorts of 3-6 patients will be infused with escalating doses of modified T cells to establish the maximum tolerated dose (MTD). There are four planned dose levels: $3\times10^5$, $1\times10^6$, $3\times10^6$, and $1\times10^7$ FOLR1 CAR-T cells/kg. Cohorts I and II will be treated with 3×105 FOLR1 [SEQ ID NO: 2120 or 2121] CAR-T cells/kg but patients in cohort II will also receive lymphodepleting cyclophosphamide. Cohorts II-V will receive escalating doses of the modified T cells following pretreatment with cyclophosphamide. Lymphodepleting cyclophosphamide dosed at 750 mg/m2 will be administered 2-4 days prior to the initial T cell infusion. A standard 3+3 dose escalation schema will be followed. If the first dose level exceeds the MTD, a subsequent cohort of 3-6 patients will be treated at the −1 dose level of $1\times10^5$ FOLR1 CAR-T cells/kg without the addition of lymphodepleting cyclophosphamide (cohort-I).

An IP catheter will be placed prior to T cell infusion. The catheter will be placed when the modified T cells are ready for administration. Patients will be admitted to the inpatient unit of the hospital prior to their first infusion of CAR T cells and will remain hospitalized until at least 3 days after the second infusion of CAR T cells. The first cohort of patients to be treated, and the first patient treated in each subsequent cohort, will be admitted to the intensive care unit (ICU); subsequent patients may be admitted to the medical oncology in-patient service (subject to the clinical judgment of the treating physician).

Patients will receive a single dose of lymphodepleting cyclophosphamide (750 mg/m2 IV) chemotherapy 2 to 4 days prior to initiating treatment with CAR-modified T cells. The transduced T cells will be quality tested for number, purity, viability, and sterility prior to infusion. All patients will receive 50% of the genetically modified T cell dose intravenously. Patients will be closely monitored for toxicities. One to 3 days later, the remaining dose of T cells will be administered as an IP infusion.

Blood samples will be obtained from all patients prior to and following treatment to assess toxicity, therapeutic effects, and survival of the genetically modified T cells.

Use of CAR-T cells for intratumoral injection. CAR-T cells can also be administered intra-tumorally, essentially as described in Brown C E, et al, Clin Cancer Res. 2015 Sep. 15; 21(18): 4062-4072. In the following example, this approach is used in case of patients with recurrent glioblastoma (GBM) which expresses EGFRviii. Essentially a similar approach can be used for intra-tumoral injection of CAR-T cells targeting other tumor antigens.

A pilot safety and feasibility study will be conducted to test CAR (SEQ ID NO:1699 or 1700) expressing T cells in recurrent GBM. All participating patients will be required to give written informed consent. Eligible patients will include adults (18-70 yrs) with recurrent or refractory unifocal supratentorial grade III or IV glioma whose tumors do not show communication with ventricles/CSF pathways and are amenable to resection. Patients will be enrolled following initial diagnosis of high-grade glioma (WHO grade III or IV), at which time they will undergo leukapheresis for collection of peripheral blood mononuclear cells (PBMC). These cells will be used to engineer T cells to express the EGFRviii CAR (SEQ ID NO:1699 or 1700) following infection with the corresponding lentiviral vector as described in the previous examples. Alternatively, the CAR-T cells could be generated following infection with a retroviral vector or using sleeping beauty transposon or by transfection of IVT mRNA. Subsequently, the release tested therapeutic CAR-T cells will be cryopreserved and stored for later use. At the time of first recurrence of the tumor, the research participant will undergo resection of tumor along with placement of a Rickham reservoir/catheter. Concurrently, the therapeutic CAR-T cells will be thawed, re-expanded in vitro using CD3/CD28 beads based rapid expansion protocol. Following recovery from surgery and post baseline MR imaging, the CAR-T cells will be administered directly into the resection cavity via the indwelling catheter, essentially as described (Brown et al., Clin Cancer Res. 2015 Sep. 15; 21(18): 4062-4072). Cells will be manually injected into the Rickham reservoir using a 21 gauge butterfly needle to deliver a 2 mL volume over 5-10 minutes, followed by 2 mL flush with preservative free normal saline over 5 minutes. The protocol treatment plan will specify an intra-patient dose escalation schedule with a target of 12 CAR-T cell doses administered intracranially over a 5 weeks period comprised of weekly treatment cycles. During cycles 1, 2, 4 and 5, T cell infusions will be performed on days 1, 3 and 5 of the cycle week, and week 3 will be a rest cycle. For safety, in cycle 1 we will utilize an intrapatient dose escalation strategy, with CART cell doses of $10^7$, $5\times10^7$ and $10^8$ cells per infusion administered on days 1, 3 and 5 respectively, and this will be followed by 9 additional CAR-T cell infusions of $10^8$ cells over 4 weeks. Imaging to assess response will be performed during the week 3 rest cycle and after week 5. The guidelines provided in the NCI Common Toxicity Criteria version 2.0 (https://ctep.ifo.nih-.gov/1) will be followed for the monitoring of toxicity and adverse event reporting.

Use of CAR-T cells for ex-vivo purging of bone marrow or peripheral blood stem cell preparation prior to transplant. CAR-T cells can be used to purge the bone marrow or peripheral blood stem cell preparation of cancer cells prior to stem cell transplant. In the following example, BCMA expressing CAR-T cells are used to purge bone marrow or peripheral blood stem cells obtained from a patient with multiple myeloma prior to autologous stem cell (or bone marrow) transplant. Essentially a similar approach can be used to purge bone marrow or peripheral blood stem cell preparations using CAR-T cells targeting other suitable antigens that are expressed on cancer cells and have no or negligible expression on normal hematopoietic stem cells.

Patient will undergo leukopheresis to collect peripheral blood mononuclear cells (PBMC). T cells will be purified using CD3 beads. These cells will be used to engineer T cells to express the BCMA CAR CD8SP-BCMA-BB-CAR02-vL-[4hTCRa-CSDVP]-F-F2A-SP-BCMA-BB-CAR02-vH-[hTCRb-KACIAH]-F-P2A-Xba-PAC [SEQ ID NO: 546] containing the puromycin resistance gene (PAC) following infection with the corresponding lentiviral vector as described in the previous examples. This CAR targets BCMA, an antigen expressed on myeloma cells. CAR-T expressing the CAR CD8SP-BCMA-BB-CAR02-vL-[hTCRb-KACIAH]-F-P2A-SP-BCMA-BB-CAR02-vH-[hTCRa-CSDVP]-F-F2A-PAC [SEQ ID NO: 552] or CD8SP-BCMA-BB-CAR02-vL-IgCL-Bam-CD3zECDTMCP-opt-F-P2A-Spe-SP-Bst-BCMA-BB-CAR02-vH-IgG1-CH1-KPN-CD3zECDTMCP-opt2-F-F2A-Xba-PAC [SEQ ID NO: 553] will be used as alternatives or in combination with the above CAR-T cells targeting CS1. Alternatively, the CAR-T cells could be generated following infection with a retroviral vector or using sleeping beauty transposon or by transfection of IVT mRNA. Subsequently, the release tested therapeutic CAR-T cells will be cryopreserved and stored for later use or used fresh. Bone marrow cells and peripheral blood progenitor cell products will be collected from a patient with multiple myeloma following standard procedures. For mobilization of peripheral blood stem cells, patients will received cyclophosphamide, 3 gm/m2 followed by G-CSF, 10 μg/kg subcutaneously each day beginning 24 h after cyclophosphamide until pheresis was complete. Peripheral blood stem cells will be collected once the peripheral blood CD34+-cell count was 15 cells/μl. The collection goal will be to process three blood volumes per day until a minimum of 2.0 times $10^6$ CD34+ cells/kg are reached after processing. The bone marrow and peripheral blood stem cell products will be optionally depleted of Red Blood Cells and/or enriched for CD34 expressing cells using CliniMACS Prodigy® System from Miltenyi Biotec and following the manufacturer's recommendations. The products will be used for ex vivo purging fresh or cryopreserved. For purging, the bone marrow or peripheral blood stem cell products will be cocultured with thawed CAR-T cells at an effector to target ratio ranging from 5:1 to 30:1 for 4 to 24 hours in XVIVO medium (Lonza) supplanted with 100 IU recombinant human-IL2. Cells will be cultured at 37° C., in a 5% CO2 humidified incubator. At the end of the coculture period, an aliquote of the cells will be taken for sterility and quality testing (including measurement of CFU-GM and flow cytometry for CD34 and CD138 positive cells). The remaining sample will be administered intravenously to the patient who has previously received myeloablative chemotherapy (e.g., high dose Melphalan in two divided doses of 70 mg/$m^2$ for a total dose of 140 mg/$m^2$).

Use of in vitro and vivo selection to select CARs with desired properties. A pool of CARs targeting CD19 listed in Tables 7 are targeted to the TRAC locus in T cells using TRAC gRNA and techniques known in the art. The targeting vector also carry DNA barcodes located downstream of the stop codon of the CAR inserts. T cells can be derived from peripheral blood. In an alternate embodiment, T cells are derived from a single clone of iPSC or hematopoietic stem cells using techniques known in the art. T cells expressing the pool of CARs are co-cultured with RAJI cells in vitro for 1 to 21 days. Aliquotes of the CAR-T cell pools are collected before the culture with the target cells and on different days after co-culture. Samples are subjected to next generation sequencing to determine the relative frequency of different CARs following exposure to the target cells. Bioinformatics analyses is used to determine the CARs that are associated with better proliferative response following co-culture with the target cells. Essentially a similar approach is used to determine the CARs that confer higher proliferative potential on T cells in vivo and/or persist long term in vivo and/or are present at higher frequency when normalized for their frequency in the starting T cell population in surviving animals as compared to animals that succumb to tumor challenge. In alternate embodiment of the disclosure, essentially a similar approach is used on human clinical samples to identify CARs that are associated with different properties and/or outcomes including but not limited to better long term survival, lower incidence of cytokine release syndrome, lower neurotoxicity and/or higher long term persistence. Such CARs can be subsequently used, either singly or in various combinations, to develop different CAR subpools, containing CARs targeting the same or different antigen binding domains, with diverse properties for the treatment of different disease conditions and different patients. In other enablements, the CAR-T cells are exposed to their target cell line and then sorted into different sets based on the degree of intracellular IFNγ as determined by flow cytometry. The frequency of different CARs in the low vs high IFNγ population is determined by next generation sequencing and normalized to their frequency in the control CAR-T cell population, i.e., CAR-T cells that have not been exposed to the target cell line or are exposed to a cell line that does not express the target of CARs. From this analysis, CARs that are associated with different levels of IFNγ production can be determined. A similar approach is used to screen for and select CARs with any or a combination of desired properties or attributes including but not limited to, lower TNFα production, lower expression of exhaustion markers, lower expression of markers of terminal differentiation and/or higher expression of markers of cytotoxicity.

HIV-1 Vif Protein enhance lentiviral mediated gene transduction and expression.

293FT cells were plated in 10 ml of DMEM-10 medium without antibiotics in a 10 cm tissue culture plate so that they will be approximately 80% confluent on the day of transfection. The following day, the cells were transfected by calcium phosphate transfection method using 10 μg of lentiviral expression plasmid encoding a SEQ ID NO: 11244) or a $2^{nd}$ generation CAR targeting CD19 and co-expressing HIV-1 Vif protein (SEQ ID NO: 11245) and packaging plasmids (7.5 μg of PSPAX2 plasmid and 2 μg of PLP/VSVG). Approximately 15-16 hours post-transfection, 9 ml of media is removed and replaced with 5 ml of fresh media. Approximately, 48 hours post-transfection, 5 ml of supernatant is collected (first collection) and replaced with fresh 5 ml media. Approximately 72 hrs post-transfection, all media was collected (second collection, usually around 6 ml). The collected supernatants are pooled and centrifuged at 1000 rpm for 1 minute to remove any cell debris and non-adherent cells. The cell-free supernatant are filtered through 0.45 μm syringe filter. The titer of the lentiviruses are measured using p24 ELISA. Buffy coat cells are obtained from healthy de-identified adult donors from the Blood Bank and used to isolate peripheral blood mononuclear cells (PBMC) by Ficoll-Hypaque gradient centrifugation. PBMC are used to isolate T cells using CD3 magnetic microbeads (Miltenyi Biotech) and following the manufacturer's instructions. T cells are re-suspended in XVIVO medium (Lonza) supplanted with 10 ng/ml CD3 antibody, 10 ng/ml CD28 antibody and 100 IU recombinant human-IL2. Purified T cells are infected with equal amounts of lentivirus vector encoding the 2nd generation CAR targeting CD19 (SEQ ID NO: 11244) or a 2nd generation CAR targeting CD19 and co-expressing HIV-1 Vif protein (SEQ ID NO: 11245). Both the CAR constructs also carry a MYC epitope tag. The expression of CAR on the T cells is examined by immunostaining with an APC-conjugated MYC antibody and FACS analysis at 48 hours after the infection. A significantly higher percentage of T cells are found to be infected with the CAR construct co-expressing Vif as compared to the CAR construct without Vif expression.

FACS analysis is repeated at 3 days after infection. Again, a significantly higher percentage of T cells are found to be infected with the CAR construct co-expressing Vif as compared to the CAR construct without Vif expression.

The experiment is also repeated in BC-1 cell line. Again, a significantly higher percentage of BC-1 cells are found to be infected with the CAR construct co-expressing Vif as compared to the CAR construct without Vif expression.

SEQUENCE LISTING (16363 sequences)

SEQ ID NO: 1 - DNA, 63 bp, Artificial Sequence
  Synthetic Polynucleotide
atggccttaccagtgaccgccttgctcctgccgctggccttgctgctccacgccgccaggccg

SEQ ID NO: 2 - DNA, 63 bp, Artificial Sequence
  Synthetic Polynucleotide
atggccctgcccgtgacagccctgctgctgcctctggctctgctgctgcacgccgccagaccc

SEQ ID NO: 3 - DNA, 57 bp, Artificial Sequence
  Synthetic Polynucleotide
atggattggatatggaggatactttttctcgtgggggcagcaaccggggctcattcc

SEQ ID NO: 4 - DNA, 57 bp, Artificial Sequence
  Synthetic Polynucleotide
atggactggatttggcgcatccttttccttgtcggcgctgctaccggcgcgcattcc

SEQ ID NO: 5 - DNA, 45 bp, Artificial Sequence
  Synthetic Polynucleotide
ggcggaggcggaagtggaggcggaggatctggcggcggaggctct

SEQ ID NO: 6 - DNA, 75 bp, Artificial Sequence
  Synthetic Polynucleotide
agcagcgccgacgacgccaagaaggacgccgccaaaaaggatgatgccaagaaagacgatgctaaaaaagacggc

SEQ ID NO: 7 - DNA, 120 bp, Artificial Sequence
  Synthetic Polynucleotide
ggctcagcatggtctcatcctcagtttgaaaaaggtggagggtccgggggcggcagtggtggtagtgcttggtcccatccacagtttgaaaagtcgcgttcctccggaggtggtggctcc

SEQ ID NO: 8 - DNA, 21 bp, Artificial Sequence
  Synthetic Polynucleotide
cctggcggaggcgggtctcct

SEQ ID NO: 9 - DNA, 21 bp, Artificial Sequence
  Synthetic Polynucleotide
cctggtggcggaggatctcct

SEQ ID NO: 10 - DNA, 21 bp, Artificial Sequence
  Synthetic Polynucleotide
gaggttgcggcgctcgaaagg

SEQ ID NO: 11 - DNA, 21 bp, Artificial Sequence
  Synthetic Polynucleotide
cgtgtggctgcgctcaaggag

SEQ ID NO: 12 - DNA, 15 bp, Artificial Sequence
  Synthetic Polynucleotide
gaggccgcagcaaag

SEQ ID NO: 13 - DNA, 15 bp, Artificial Sequence
  Synthetic Polynucleotide
gaagcagccgccaag

SEQ ID NO: 14 - DNA, 36 bp, Artificial Sequence
  Synthetic Polynucleotide
gagcagaaactgatctcggaagaggatgggagcggc

SEQ ID NO: 15 - DNA, 36 bp, Artificial Sequence; identical to SEQ ID NO: 14
  Synthetic Polynucleotide

SEQ ID NO: 16 - DNA, 39 bp, Artificial Sequence
  Synthetic Polynucleotide
gagcagaaactgatctcggaagaggatctggggagcggc

SEQ ID NO: 17 - DNA, 39 bp, Artificial Sequence
  Synthetic Polynucleotide
gaacagaaattgataagtgaggaagacttgggcagcggc

SEQ ID NO: 18 - DNA, 39 bp, Artificial Sequence; identical to SEQ ID NO: 16
  Synthetic Polynucleotide

SEQ ID NO: 19 - DNA, 51 bp, Artificial Sequence
  Synthetic Polynucleotide
gggaaaccaattcccaaccctcttctgggactggattcaaccggcagcggc

SEQ ID NO: 20 - DNA, 36 bp, Artificial Sequence
  Synthetic Polynucleotide
tacccctacgatgtgcccgattacgctggcagcggc

SEQ ID NO: 21 - DNA, 27 bp, Artificial Sequence
  Synthetic Polynucleotide
caccatcatcaccatcacggcagcggc

SEQ ID NO: 22 - DNA, 45 bp, Artificial Sequence
  Synthetic Polynucleotide
ggcctgaacgacatcttcgaggctcagaagatcgaatggcacgag

SEQ ID NO: 23 - DNA, 39 bp, Artificial Sequence
  Synthetic Polynucleotide
gggtctggaggcggaggcagcggcggaggcgggagcggc

SEQ ID NO: 24 - DNA, 39 bp, Artificial Sequence
  Synthetic Polynucleotide
ggcagcggcggaggcggaagtggaggcggaggcagcggc

SEQ ID NO: 25 - DNA, 33 bp, Artificial Sequence
  Synthetic Polynucleotide
tggtctcatccccagtttgaaaagggcagcggc

SEQ ID NO: 26 - DNA, 33 bp, Artificial Sequence
  Synthetic Polynucleotide
tggtcccatccccagttcgagaaaggcagcggc

SEQ ID NO: 27 - DNA, 34 bp, Artificial Sequence
  Synthetic Polynucleotide
gattataaagatgatgacgataaagggcagcggc

SEQ ID NO: 28 - DNA, 318 bp, Artificial Sequence
  Synthetic Polynucleotide
ggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagc

SEQ ID NO: 29 - DNA, 309 bp, Artificial Sequence
  Synthetic Polynucleotide
gcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgt

SEQ ID NO: 30 - DNA, 303 bp, Artificial Sequence
  Synthetic Polynucleotide
gcctcaacgaaagggcctagcgtcttccccctggcgccgtgctcacgatccacaagcgaatccaccgccgctctcggatgcctcgtaaaggattatttccctgaaccagtcacggtgtcatggaacagcggtgcccttaccagcggcgtccatacctttcctgctgtgctccagtccagcggactttatagtctcagctctgtcgtgaccgtcccttcctctaattttggcacccagacttacacgtgcaacgtcgatcataagcccagtaacaccaaggtagacaagacggtggaacgaaag

SEQ ID NO: 31 - DNA, 306 bp, Artificial Sequence
  Synthetic Polynucleotide
gcctccacgaagggaccatctgttttccctcttgccccctgctcacggtcaacgtctgaatccacggcagccctgggctgcctcgttaaggactactttccagagccggtaacagtctcctggaacagtggagcccttacatcaggtgttcacactttccctgccgtcttgcaaagtagcggactgtacagccttagttccgttgttacggttccttctagcaacttcggtacacagacatatacttgtaacgtagatcataagcctagcaacaccaaggtggacaaaaccgtagagagaaagtgt

SEQ ID NO: 32 - DNA, 309 bp, Artificial Sequence
  Synthetic Polynucleotide
gcaagtacaaagggacccagtgttttcccgctcgccccctgttcacgatcaacgagtgagtccactgcggctctcggatgcctcgtcaaagactacttccccgagccggtgactgttagttggaactctggggctcttacttcaggcgtacacacattccccgccgtgcttcagtcaagtgggctctactcacttagcagtgtggtaacggttccctctagcaactttggcacccaaacatatacttgcaacgtcgatcacaagccgtcaaataccaaagttgacaagaccgttgaaaggaaatgttgt

SEQ ID NO: 33 - DNA, 309 bp, Artificial Sequence
  Synthetic Polynucleotide
gcgtccactaagggtccgtcagtcttcccgctggcgccctgttcccgcagcacgagtgaatctaccgccgcccttgggtgcttggtaaaagactattttcctgagcccgttacagtatcatggaacagcggggctctgactagcggggtgcatacgttccctgcggttctgcaatctagcggactgtattctctctccagtgttgtgaccgtgccaagctccagcctcggtactaaaacttatacatgtaatgtggatcataaaccttcaaataccaaggttgacaaaagggtagagagtaagtacggt

SEQ ID NO: 34 - DNA, 363 bp, Artificial Sequence
  Synthetic Polynucleotide
gcgtctcccacttctccgaaagttttccccctttccctctgtagcacacaacctgatggaaatgtggtcatcgcatgtctggtacaaggattctttccacaagagccattgagcgttacatggtcagagagcgggcagggagttaccgctaggaatttcccaccctcacaggatgcgagtggtgatctttataccacatcatcacaactcacgttgccagccactcagtgcctcgctggaaagtcagtaacatgccatgtcaaacattacactaatccctcacaagatgttaccgtgccttgcccagtaccttctacgccgcccaccccgtctccatctactccacccacgccatcacctagt

SEQ ID NO: 35 - DNA, 324 bp, Artificial Sequence
  Synthetic Polynucleotide
gcgtcacctacgtccccaaaagtgttcccgctgtcactcgattccactccacaggacggtaacgtggtggttgcctgcctggtacaaggtttctttcctcaagaaccactctctgtgacgtggtctgaaagtggtcagaatgttacagcacggaacttcccaccgagtcaagatgcgagtggggatctctatacgacatccagtcaactcacactgcccgcaacacaatgccccgatggcaaatctgttacctgccatgtgaaacattacaccaatccatcccaggatgtgacagtaccttgtccggttccgccccctcccccg

SEQ ID NO: 36 - DNA, 477 bp, Artificial Sequence
  Synthetic Polynucleotide
gctccgacaaaggcgccagacgtttttcctattatttcaggatgtcggcatccgaaagataattccccagttgttctggcgtgtcttatcacgggctaccatcctacatctgttaccgttacgtggtatatgggtacgcaaagccaacctcagcggacttttccagagatccaacggcgagattcatattatatgacatccagtcagttgagtacaccgctgcaacagtggcggcaaggtgagtataagtgtgtggtccaacacacagccagtaaaagtaagaaagagatattccggtggcctgaaagcccgaaggcacaagcatcttctgttccgacggcgcaaccgcaagctgaaggaagtcttgcaaaagcaaccacagcacccgcgacaacacgaaacacaggacgcggaggcgaggaaaagaaaaaagaaaaggaaaaggaagagcaagaggagagggaaactaagaccccc

SEQ ID NO: 37 - DNA, 309 bp, Artificial Sequence
  Synthetic Polynucleotide
gctagtacccagtcaccttctgttttcccgcttactagatgctgcaagaacataccatccaatgccacttctgtcacactgggctgtcttgctacaggttattttcctgagccggtgatggtcacttgggataccggtagcctgaatggaactacaatgacgctgcctgccacgacgctcacattgagtgggcattacgcgacaattagtcttttgacggtaagcggagcttgggctaagcagatgttcacttgcagagtagcgcacactccctctagtactgactgggttgacaacaaaaccttttct

SEQ ID NO: 38 - DNA, 312 bp, Artificial Sequence
  Synthetic Polynucleotide
gggtcagcaagtgcgcccacgctctttccattggtttcttgcgagaactctccctcagacacatcaagtgtcgcggtaggctgtctcgcccaagattttttgcccgatagtataacgctgtcatggaaatataagaacaatagtgatataagctccacaaggggttttccgagcgtactgcgaggcggtaaatatgcagcgacgagtcaagtcttgctcccatccaaggatgtcatgcaaggcaccgatgagcatgttgtttgcaaagtgcaacatccgaatggaaataaggaaaaaaacgtcccgctgccc

SEQ ID NO: 39 - DNA, 423 bp, Artificial Sequence
  Synthetic Polynucleotide
gatatccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagc

SEQ ID NO: 40 - DNA, 420 bp, Artificial Sequence
  Synthetic Polynucleotide
atccagaaccctgaccctgccgtgtaccagctgagagactctaaatccagtgacaagtctgtctgcctattcaccgattttgattctcaaacaaatgtgtcacaaagtaaggattctgatgtgtatatcacagacaaaactgtgctagacatgaggtctatggacttcaagagcaacagtgctgtggcctggagcaacaaatctgactttgcatgtgcaaacgccttcaacaacagcattattccagaagacaccttcttccccagcccagaaagttcctgtgatgtcaagctggtcgagaaaagctttgaaacagatacgaacctaaactttcaaaacctgtcagtgattgggttccgaatcctcctcctgaaagtggccgggtttaatctgctcatgacgctgcggctgtggtccagc

SEQ ID NO: 41 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 42 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 43 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 44 - DNA, 411 bp, Artificial Sequence
  Synthetic Polynucleotide
cctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 45 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 46 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 47 - DNA, 420 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagc

SEQ ID NO: 48 - DNA, 717 bp, Artificial Sequence
  Synthetic Polynucleotide
atccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 49 - DNA, 531 bp, Artificial Sequence
  Synthetic Polynucleotide
gaggacctgaacaaggtgttcccacccgaggtcgctgtgtttgagccatcagaagcagagatctcccacacccaaaaggccacactggtgtgcctggccacaggcttcttccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggctttacctcggtgtcctaccagcaaggggtcctgtctgccaccatcctctatgagatcctgctagggaaggccaccctgtatgctgtgctggtcagcgcccttgtgttgatggccatggtcaagagaaaggatttc

SEQ ID NO: 50 - DNA, 537 bp, Artificial Sequence
  Synthetic Polynucleotide
gaggacctgaaaaacgtgttcccacccgaggtcgctgtgtttgagccatcagaagcagagatctcccacacccaaaaggccacactggtatgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacccgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggc

SEQ ID NO: 51 - DNA, 537 bp, Artificial Sequence; identical to SEQ ID NO: 50
  Synthetic Polynucleotide

SEQ ID NO: 52 - DNA, 537 bp, Artificial Sequence
  Synthetic Polynucleotide
gaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 53 - DNA, 537 bp, Artificial Sequence
  Synthetic Polynucleotide
gaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 54 - DNA, 537 bp, Artificial Sequence
  Synthetic Polynucleotide
gaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 55 - DNA, 537 bp, Artificial Sequence
  Synthetic Polynucleotide
gaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 56 - DNA, 537 bp, Artificial Sequence
  Synthetic Polynucleotide
gaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccgggga

SEQ ID NO: 57 - DNA, 828 bp, Artificial Sequence
  Synthetic Polynucleotide
gaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaaga

SEQ ID NO: 58 - DNA, 807 bp, Artificial Sequence
  Synthetic Polynucleotide
  misc_feature (540)..(540): n is a, c, g, or t
gggtgtccagccctacccacaggtgtgggcggcacaccctttccttctctggccccaccaatcatgctgctggtggatggaaagcagcagatggtggtggtctgcctggtccttgatgttgcaccccctggccttgacagccccatctggttctcagccggcaatggcagtgcactggatgccttcacctatggcccttccccagcaacggatggcacctggaccaacttggcccatctctccctgccttctgaggagctggcatcctgggagcctttggtctgccacactgggcctggggctgagggtcacagcaggagtacacagcccatgcatctgtcaggagaggcttctacagccaggacctgcccccaggagcctctcagggggacaccgggtggggcgctgtggctgggggtcctgcggctgctgctcttcaagctgctgctgtttgacctgctcctgacctgcagctgcctgtgcgaccccgcgggcccgctgccttcccccgcaaccaccacccgcctgcgagccctcggntcccatcgactgcacccggccacggagactgggggacgagaggccaccagctcacccagaccccagcctcgggaccgccgctggggtgacacccctccgggtcggaagcccgggagcccagtatggggggaagggtcttacctcagcagttaccccacttgcccagcacaggcctggtgctcaagatctcgcctcagggctccttcctccagtcttggagcattttttgcaggtgacctgcctcctcctctgcaggctggagctgcc

SEQ ID NO: 59 - DNA, 774 bp, Artificial Sequence
  Synthetic Polynucleotide
accccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtgtggggcgagggcagctacctgagcagctaccctacatgccctgcccaggcttggtgcagcagaagcgcactgagagcacccagctctagcctgggagccttctttgccggcgatctgcctccaccactccaggctggcgctgct

SEQ ID NO: 60 - DNA, 630 bp, Artificial Sequence
  Synthetic Polynucleotide
accccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtc

SEQ ID NO: 61 - DNA, 567 bp, Artificial Sequence
  Synthetic Polynucleotide
gataaacaacttgatgcagatgtttcccccaagcccactatttttcttccttcaattgctgaaacaaaactccagaaggctggaacatacctttgtcttcttgagaaatttttcccagatattattaagatacattggcaagaaaagaagagcaacacgattctgggatcccaggaggggaacaccatgaagactaacgacacatacatgaaatttagctggttaacggtgccagaagagtcactggacaaagaacacagatgtatcgtcagacatgagaataataaaaacggaattgatcaagaaattatctttcctccaataaagacagatgtcaccacagtggatcccaaatacaattattcaaaggatgcaaatgatgtcatcacaatggatcccaaagacaattggtcaaaagatgcaaatgatacactactgctgcagctcacaaacacctctgcatattacatgtacctcctcctgctcctcaagagtgtggtctattttgccatcatcacctgctgtctgcttggaagaacggctttctgctgcaatggagagaaatca

SEQ ID NO: 62 - DNA, 519 bp, Artificial Sequence
  Synthetic Polynucleotide
gacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtct

SEQ ID NO: 63 - DNA, 459 bp, Artificial Sequence
  Synthetic Polynucleotide
agtcagcctcataccaaaccatccgtttttgtcatgaaaaatggaacaaatgtcgcttgtctggtgaaggaattctaccccaaggatataagaataaatctcgtgtcatccaagaagataacagagtttgatcctgctattgtcatctctcccagtgggaagtacaatgctgtcaagcttggtaaatatgaagattcaaattcagtgacatgttcagttcaacacgacaataaaactgtgcactccactgactttgaagtgaagacagattctacagatcacgtaaaaccaaaggaaactgaaaacacaaagcaaccttcaaagagctgccataaacccaaagccatagttcataccgagaaggtgaacatgatgtccctcacagtgcttgggctacgaatgctgtttgcaaagactgttgccgtcaattttctcttgactgccaagttatttttcttg

SEQ ID NO: 64 - DNA, 459 bp, Artificial Sequence
  Synthetic Polynucleotide
agccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctc

SEQ ID NO: 65 - DNA, 90 bp, Artificial Sequence
  Synthetic Polynucleotide
cagagcttcggcctgctggaccccaagctgtgctacctgctggatggcatcctgttcatctacggcgtgatcctgaccgccctgttcctg

SEQ ID NO: 66 - DNA, 429 bp, Artificial Sequence
  Synthetic Polynucleotide
cagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaaga

SEQ ID NO: 67 - DNA, 429 bp, Artificial Sequence; identical to SEQ ID NO: 66
  Synthetic Polynucleotide

SEQ ID NO: 68 - DNA, 123 bp, Artificial Sequence
  Synthetic Polynucleotide
aggagtaagaggagcaggctcctgcacagtgactacatgaacatgactccacgccgccccggacccacccgcaagcattaccagccctatgccccaccacgcgacttcgcagcctatcgctcc

SEQ ID NO: 69 - DNA, 126 bp, Artificial Sequence
  Synthetic Polynucleotide
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 70 - DNA, 165 bp, Artificial Sequence
  Synthetic Polynucleotide
aagaaccggaaggccaaggccaagcctgtgacaagaggtgctggtgctggcggcagacagagaggccagaacaaagaaagacctcctcctgtgcctaatcctgactacgagcccatcagaaaaggccagcgggatctgtacagcggcctgaaccagcggcggatc

SEQ ID NO: 71 - DNA, 90 bp, Artificial Sequence
  Synthetic Polynucleotide
cagagttttgggttgttggaccctaaattgtgctatctgttggacggaatcctgttcatttacggagtgatcctgaccgcattgttcctg

SEQ ID NO: 72 - DNA, 339 bp, Artificial Sequence
  Synthetic Polynucleotide
cgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 73 - DNA, 429 bp, Artificial Sequence
  Synthetic Polynucleotide
cagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 74 - DNA, 123 bp, Artificial Sequence
  Synthetic Polynucleotide
aggagcaagcggtcacggctgctccacagcgattacatgaatatgacaccacgaagaccgggtcctactcgcaaacactaccaaccctacgcacctccccgcgactttgcagcgtaccgatct

SEQ ID NO: 75 - DNA, 126 bp, Artificial Sequence
  Synthetic Polynucleotide
aagagaggccggaagaagctgctgtacatcttcaagcagcctttcatgcggcccgtgcagaccacccaggaagaggacggctgctcctgccggttccccgaggaagaagaaggcggctgcgagctg

SEQ ID NO: 76 - DNA, 552 bp, Artificial Sequence
  Synthetic Polynucleotide
cagagcttcggcctgctggaccccaagctgtgctacctgctggatggcatcctgttcatctacggcgtgatcctgaccgccctgttcctgaggagtaagaggagcaggctcctgcacagtgactacatgaacatgactccacgccgccccggacccacccgcaagcattaccagccctatgccccaccacgcgacttcgcagcctatcgctccagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaaga

SEQ ID NO: 77 - DNA, 555 bp, Artificial Sequence
  Synthetic Polynucleotide
cagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaaga

SEQ ID NO: 78 - DNA, 552 bp, Artificial Sequence
  Synthetic Polynucleotide
cagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 79 - DNA, 555 bp, Artificial Sequence
  Synthetic Polynucleotide
cagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 80 - DNA, 66 bp, Artificial Sequence
  Synthetic Polynucleotide
gtgaagcagaccctgaatttcgacctgctgaagctggctggcgacgtggaatccaacccaggccct

SEQ ID NO: 81 - DNA, 54 bp, Artificial Sequence
  Synthetic Polynucleotide
gagggcagaggaagtctactaacctgcggagatgtggaagaaaatcctggccca

SEQ ID NO: 82 - DNA, 54 bp, Artificial Sequence
  Synthetic Polynucleotide
gagggaagaggtagcctcctcacctgtggggacgttgaagagaaccccggccca

SEQ ID NO: 83 - DNA, 57 bp, Artificial Sequence
  Synthetic Polynucleotide
gcaacaaacttctcactactcaaacaagcaggtgacgtggaggagaatcccgggcct

SEQ ID NO: 84 - DNA, 57 bp, Artificial Sequence
  Synthetic Polynucleotide
gcaacaaacttctcactactcaaacaagcaggtgacgtggagcagaatcccgggcct

SEQ ID NO: 85 - DNA, 60 bp, Artificial Sequence
  Synthetic Polynucleotide
caatgcactaattacgcattgctcaagctggccggtgacgttgagagtaatcctggcccc

SEQ ID NO: 86 - DNA, 12 bp, Artificial Sequence
  Synthetic Polynucleotide
tctggatctgga

SEQ ID NO: 87 - DNA, 12 bp, Artificial Sequence
  Synthetic Polynucleotide
agcggatctggc

SEQ ID NO: 88 - DNA, 12 bp, Artificial Sequence
  Synthetic Polynucleotide
cgggccaagaga

SEQ ID NO: 89 - DNA, 12 bp, Artificial Sequence
  Synthetic Polynucleotide
agggccaagcga

SEQ ID NO: 90 - DNA, 12 bp, Artificial Sequence
  Synthetic Polynucleotide
cgcgccaagaga

SEQ ID NO: 91 - DNA, 597 bp, Artificial Sequence
  Synthetic Polynucleotide
atgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcc

SEQ ID NO: 92 - DNA, 396 bp, Artificial Sequence
  Synthetic Polynucleotide
atggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggc

SEQ ID NO: 93 - DNA, 516 bp, Artificial Sequence
  Synthetic Polynucleotide
atgggcaacgaggccagctaccctctggagatgtgctcccacttcgacgccgacgagatcaagcggctgggcaagcgcttcaagaagctggacctggacaacagcggcagcctgagcgtggaggagtttatgtctctgcccgagctgcagcagaaccccctggtgcagcgcgtgatcgacatcttcgacaccgacggcaacggcgaggtggacttcaaggagttcatcgagggcgtgagccagttcagcgtgaagggcgacaaggagcagaagctgcggttcgccttccgcatctacgatatggataaagatggctatatttctaatggcgagctgttccaggtgctgaagatgatggtgggcaacaataccaagctggccgatacccagctgcagcagatcgtggacaagaccatcatcaacgccgacaaggacggcgacggcagaatcagcttcgaggagttctgtgccgtggtgggaggcctggatattcacaaaaaaatggtggtggacgtg

SEQ ID NO: 94 - DNA, 1071 bp, Artificial Sequence
  Synthetic Polynucleotide
atgctgctgctcgtgaccagcctgctgctgtgcgaactgccccaccctgcctttctgctgatcccccggaaagtgtgcaacggcatcggcatcggagagttcaaggacagcctgagcatcaacgccaccaacatcaagcacttcaagaactgcaccagcatcagcggcgacctgcacatcctgcccgtggcctttagaggcgacagcttcacccacacccccccactggaccctcaggaactggacatcctgaaaaccgtgaaagagatcaccggatttctgctgattcaggcttggcccgagaaccggaccgatctgcacgccttcgagaacctggaaatcatccggggcaggaccaagcagcacggccagttttctctggccgtggtgtccctgaacatcaccagcctgggcctgcggagcctgaaagaaatcagcgacggggatgtgattatcagcggcaacaagaacctgtgctacgccaacaccatcaactggaagaagctgttcggcacctccggccagaaaacaaagatcatcagcaaccggggcgagaacagctgcaaggccacaggacaagtgtgccacgccctgtgtagccctgagggctgttggggacccgagcccagagattgcgtgtcctgccggaatgtgtccagaggccgcgagtgcgtggacaagtgcaacctgctggaaggcgagccccgcgagtttgtggaaaacagcgagtgcatccagtgccaccccgagtgtctgccccaggccatgaatatcacctgtaccggcagaggccccgacaactgtatccagtgcgcccactacatcgacggcccccactgcgtgaaaacctgtccagctggcgtgatgggagagaacaacaccctcgtgtggaagtacgccgacgccggccatgtgtgccacctgtgtcaccccaactgcacctacggctgtacaggccctggcctggaaggctgccctaccaacggacccaagatccccagcattgccaccggcatggtgggagcattgctgctgctgctggtggtggccctgggcatcggcctgtttatg

SEQ ID NO: 95 - DNA, 1272 bp, Artificial Sequence
  Synthetic Polynucleotide
atgcgaccctccgggacggccggggcagcgttcctggcgctgctggctgcgctctgcccggcgagtcgggctctggaggaaaagaaaggtaattatgtggtgacagatcacggctcgtgcgtccgagcctgtggggccgacagctatgagatggaggaagacggcgtccgcaagtgtaagaagtgcgaagggccttgccgcaaagtgtgtaacggaataggtattggtgaatttaaagactcactctccataaatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacagggtttttgctgattcaggcttggcctgaaaacaggacggacctccatgcctttgagaacctagaaatcatacgcggcaggaccaagcaacatggtcagttttctcttgcagtcgtcagcctgaacataacatccttgggattacgctccctcaaggagataagtgatggagatgtgataatttcaggaaacaaaaatttgtgctatgcaaatacaataaactggaaaaaactgtttgggacctccggtcagaaaaccaaaattataagcaacagaggtgaaaacagctgcaaggccacaggccaggtctgccatgccttgtgctcccccgagggctgctggggcccggagcccagggactgcgtctcttgccggaatgtcagccgaggcagggaatgcgtggacaagtgcaaccttctggagggtgagccaagggagtttgtggagaactctgagtgcatacagtgccacccagagtgcctgcctcaggccatgaacatcacctgcacaggacggggaccagacaactgtatccagtgtgcccactacattgacggcccccactgcgtcaagacctgcccggcaggagtcatgggagaaaacaacaccctggtctggaagtacgcagacgccggccatgtgtgccacctgtgccatccaaactgcacctacggatgcactgggccaggtcttgaaggctgtccaacgaatgggcctaagatcccgtccatcgccactgggatggtgggggccctcctcttgctgctggtggtggccctggggatcggcctcttcatgcgaaggcgccacatcgttcggaagcgcacgctgcggaggctgctgcaggagagggagcttgtggagcct

SEQ ID NO: 96 - DNA, 999 bp, Artificial Sequence
  Synthetic Polynucleotide
atgccccctcccagactgctgttcttcctgctgttcctgacccctatggaagtgcggcccgaggaacccctggtcgtgaaagtggaagagggcgacaacgccgtgctccagtgtctgaagggcacctccgatggccctacccagcagctgacatggtccagagagagccccctgaagcccttcctgaagctgtctctgggcctgcctggcctgggcatccacatgaggccactggctatctggctgttcatcttcaacgtgtcccagcagatgggcggcttctacctgtgtcagcctggccccccaagcgagaaagcctggcagcctggctggaccgtgaacgtggaaggatctggcgagctgttccggtggaacgtgtccgatctgggcggcctgggatgcggcctgaagaacagaagcagcgaaggccccagcagccccagcggcaaactgatgagccccaagctgtacgtgtgggccaaggaccggcccgagatttgggaaggcgagcctccttgcctgccccccagagatagcctgaaccagagcctgagccaggacctgacaatggcccctggcagcacactgtggctgagctgtggcgtgccacccgactctgtgtccagaggccctctgagctggacccacgtgcaccccaagggacctaagagcctgctgagcctggaactgaaggacgacagacccgccagagatatgtgggtcatggaaaccggcctgctgctgcctagagccacagcccaggatgccggcaagtattactgccaccggggcaacctgaccatgagcttccacctggaaatcaccgccagacccgtgctgtggcactggctgctgagaaccggcggatggaaagtgtccgccgtgaccctggcctacctgatcttctgcctgtgctccctcgtgggcatcctgcatctccagcgggctctggtgctgcggcggaagagaaagagaatgaccgaccccacccggcggttc

SEQ ID NO: 97 - DNA, 246 bp, Artificial Sequence
  Synthetic Polynucleotide
atgttgcagatggctgggcagtgctcccaaaatgaatattttgacagtttgttgcatgcttgcataccttgtcaacttcgatgttcttctaatactcctcctctaacatgtcagcgttattgtaatgcaagtgtgaccaattcagtgaaaggaacgaatgcgattctctggacctgtttgggactgagcttaataatttctttggcagttttcgtgctaatgtttttgctaaggaagataaactct

SEQ ID NO: 98 - DNA, 216 bp, Artificial Sequence
  Synthetic Polynucleotide
gcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgc

SEQ ID NO: 99 - DNA, 678 bp, Artificial Sequence
  Synthetic Polynucleotide
gcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 100 - DNA, 342 bp, Artificial Sequence
  Synthetic Polynucleotide
gcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 101 - DNA, 336 bp, Artificial Sequence
  Synthetic Polynucleotide
agagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 102 - DNA, 336 bp, Artificial Sequence
  Synthetic Polynucleotide
agagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 103 - DNA, 324 bp, Artificial Sequence
  Synthetic Polynucleotide
aaaattgaagttatgtatcctcctccttacctagacaatgagaagagcaatggaaccattatccatgtgaaagggaaacacctttgtccaagtcccctatttcccggaccttctaagcccttttgggtgctggtggtggttgggggagtcctggcttgctatagcttgctagtaacagtggcctttattattttctgggtgaggagtaagaggagcaggctcctgcacagtgactacatgaacatgactccacgccgccccggacccacccgcaagcattaccagccctatgccccaccacgcgacttcgcagcctatcgctcc

SEQ ID NO: 104 - DNA, 1389 bp, Artificial Sequence
  Synthetic Polynucleotide
atgggcagcagcaagagcaagcctaaggaccccagccagagactgaatgctgctggtggacctggcgctggatctgctgctcctgtgtctagcacaagcagcctgcctctggccgctctgaacatgagagtcagaagaaggctgagcctgttcctgaacgtgcggacacaggtggccgctgattggacagctctggccgaggaaatggacttcgagtacctggaaatccggcagctggaaacccaggccgatcctacaggcagactgctggatgcttggcaaggcagaccaggcgcttctgtggggagactgcttgacctgctgacaaagctgggcagagatgacgtgctgctggaactgggacccagcatcgaggaagattgccagaagtacatcctgaagcagcaacaagaagaggccgagaagcctctgcaggttgccgccgtggatagcagcgttccaagaacagctgagctggccggcatcaccacactggatgatcctctgggacacatgcccgagagattcgacgccttcatctgctactgccccagcgacatcgtgggcaagaagcccacaaacaaggcccctcatcctaagcaagagccccaagagatcaacttccccgacgatctgcccggcagcaatactgctgcacccgtgcaagaaaccctgcacggttgtcagcccgtgacacaagaggacggcaaagaaagccggatctccgtccaagagcggcaagttggcggagtgcaggtcgagacaatctctcctggcgacggcagaacattccccaagaggggacagacctgctggcactacaccggaatgctggaagatggcaagaaggtggacagcagccgggacagaaacaagcccttcaagttcatgctgggcaagcaagaagtgattcgcggctgggaagagggcgtcgcacagatgtctgttggacagagagccaagctgacaatcagccccgactacgcctatggcgctacaggacaccctggcatcattcctccacacgccacactggtgttcgacgtggaactgctgaagctggaagtcggaggcgtccaggtggaaaccatcagtccaggcgacggacggacctttcctaagagaggccagacttgttggcattatacagggatgcttgaggacgggaagaaagtggactcctccagagatcggaacaagccgtttaagtttatgctcggaaaacaagaagtcataagaggctgggaagagggtgttgcccaaatgagcgtgggccagcgcgccaaactgaccatctctccagattatgcctacggcgcaaccggccatccaggcattattccacctcatgctaccctggtgtttgatgtcgagctgctcaaactggaa

SEQ ID NO: 105 - DNA, 1620 bp, Artificial Sequence
  Synthetic Polynucleotide
atgtgccatcagcagctcgtgattagctggttcagcctggtgttcctggcctcccccctggtggctatctgggagctgaagaaagacgtgtacgtggtggaactggactggtatcccgacgcccctggcgagatggtggtgctgacctgcgatacccccgaagaggacggcatcacctggaccctggatcagagcagcgaggtgctgggcagcggcaagaccctgaccatccaagtgaaagagttcggcgacgccggccagtacacctgtcacaagggcggagaggtgctgagccacagcttgctgctgctgcacaagaaagaggatggcatttggagcaccgacatcctgaaggaccagaaagagcccaagaacaagaccttcctgagatgcgaggccaagaactacagcggcagattcacctgttggtggctgaccaccatcagcaccgacctgaccttcagcgtgaagtccagcagaggcagcagcgaccctcagggcgtgacatgtggcgctgctacactgagcgccgagagagtgcggggcgacaacaaagaatacgagtacagcgtggaatgccaggaagatagcgcctgccctgccgccgaggaaagcctgcctatcgaagtgatggtggacgccgtgcacaagctgaagtacgagaactacaccagcagctttttcatccgggacatcatcaagcccgacccccccaagaacctccagctgaagcccctgaagaacagcagacaggtggaagtgtcctgggagtaccccgacacctggtccaccccccacagctacttcagcctgacattctgtgtgcaagtgcagggcaagtccaagcgcgagaaaaaggaccgggtgttcaccgacaagaccagcgccaccgtgatctgccggaagaacgccagcatcagcgtgcgcgcccaggatcggtactacagcagctcttggagcgagtgggccagcgtgccatgttctggcggcggaggatctgggggaggcggaagcggagggggaggatctaggaatctgcccgtggctacccccgaccccggcatgtttccttgtctgcaccacagccagaacctgctgcgggccgtgtccaacatgctccagaaggccagacagaccctggagttctacccctgcaccagcgaggaaatcgaccacgaggacatcaccaaggataagaccagcaccgtggaagcctgtctgcccctggaactgaccaagaacgagagctgcctgaacagccgggaaaccagcttcatcaccaacggctcttgcctggcttccagaaagacctccttcatgatggccctgtgcctgagcagcatctacgaggacctgaagatgtaccaggtggagttcaagaccatgaacgccaaactgctgatggaccccaagaggcagattttcctggaccagaatatgctggccgtgatcgacgagctgatgcaggccctgaacttcaacagcgagacagtgccccagaagtcctccctggaagaacccgacttctacaagaccaagatcaagctgtgcatcctgctgcacgccttcagaatccgggccgtgaccatcgacagagtgatgagctacctgaacgcctcc

SEQ ID NO: 106 - DNA, 762 bp, Artificial Sequence
  Synthetic Polynucleotide
atggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaa

SEQ ID NO: 107 - DNA, 783 bp, Artificial Sequence
  Synthetic Polynucleotide
atgatcgagacatacaaccagaccagccccagaagcgccgccaccggactgcccatcagcatgaagattttcatgtacctgctgaccgtgttcctgattacccagatgatcggcagcgccctgttcgccgtgtacctgcacagacggctggacaagatcgaggacgagcggaacctgcacgaggacttcgtgtttatgaagaccatccagcggtgcaacaccggcgagagaagcctgagcctgctgaactgcgaggaaatcaagagccagttcgagggcttcgtgaaggacatcatgctgaacaaagaggaaactaagaaagaaaacagcttcgagatgcagaagggcgaccagaacccccagattgccgcccacgtgatctctgaggccagcagcaagaccacctccgtgctccagtgggccgagaagggctactacaccatgagcaacaacctcgtgaccctggaaaacggcaagcaactgaccgtgaagcggcagggcctgtactacatctacgcccaagtgaccttctgctccaacagagaggccagctcccaggccccctttatcgccagcctgtgcctgaagtcccccggcagattcgagagaatcctgctgagagccgccaacacccacagcagcgccaagccttgtggacagcagagcatccacctgggcggcgtgttcgagcttcagcctggcgcttccgtgttcgtgaacgtgaccgaccctagccaggtgtcccacggcaccggctttaccagcttcggactgctgaagctg

SEQ ID NO: 108 - DNA, 564 bp, Artificial Sequence
  Synthetic Polynucleotide
atggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacacca

SEQ ID NO: 109 - DNA, 723 bp, Artificial Sequence
  Synthetic Polynucleotide
atgtccgactccaaggaggtccctagccttccatttttgcgacacttgctcgaagagttggacagccatgaggacagcttgctgctgtttctgtgtcacgacgcggccccgggctgcacgacggtcacgcaagctttgtgctcgcttagccaacagcgcaagctgaccctcgcggctctggtcgagatgctctacgtgctgcagcgtatggatcttctcaagagccgcttcgggctcagcaaggagggggccgagcaattgctgggcacaagctttctcacgcgctaccgcaagctcatggtttgcgtgggtgaggagctcgactcgagcgagctacgcgctctacgcttgttcgcgtgcaacctgaatccgagcctgagcacggcgctttctgagagcagccgctttgtcgagcttgtactcgcgcttgaaaacgtaggactcgtctcgccatcgagtgtttccgtgcttgcggacatgttgcgcactcttcggcgcctcgatttgtgccagcagcttgttgagtacgaacaacaagagcaagccaggtaccgttactgttacgcggcctcgccctcattgccagttcgtacgttacgtcgggggcacggcgcgagtgaacacgagcagctgtgcatgcccgtgcaagaatcctctgacagccccgagctgctgcgcacgcccgtacaagaatcctccagcgacagccccgagcaaacgact

SEQ ID NO: 110 - DNA, 1440 bp, Artificial Sequence
  Synthetic Polynucleotide
atgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggatccttcaaataacttcaggctccataatgggagaagtaaagaacaaagacttaaggaacagcttggcgctcaacaagaaccagtgaagaaatccattcaggaatcagaagcttttttgcctcagagcatacctgaagagagatacaagatgaagagcaagcccctaggaatctgcctgataatcgattgcattggcaatgagacagagcttcttcgagacaccttcacttccctgggctatgaagtccagaaattcttgcatctcagtatgcatggtatatcccagattcttggccaatttgcctgtatgcccgagcaccgagactacgacagctttgtgtgtgtcctggtgagccgaggaggctcccagagtgtgtatggtgtggatcagactcactcagggctccccctgcatcacatcaggaggatgttcatgggagattcatgcccttatctagcagggaagccaaagatgttttttattcagaactatgtggtgtcagagggccagctggaggacagcagcctcttggaggtggatgggccagcgatgaagaatgtggaattcaaggctcagaagcgagggctgtgcacagttcaccgagaagctgacttcttctggagcctgtgtactgcggacatgtccctgctggagcagtctcacagctcaccatccctgtacctgcagtgcctctcccagaaactgagacaagaaagaaaacgcccactcctggatcttcacattgaactcaatggctacatgtatgattggaacagcagagtttctgccaaggagaaatattatgtctggctgcagcacactctgagaaagaaacttatcctctcctacaca

SEQ ID NO: 111 - DNA, 588 bp, Artificial Sequence
  Synthetic Polynucleotide
atgtctgctgaagtcatccatcaggttgaagaagcacttgatacagatgagaaggagatgctgctctttttgtgccgggatgttgctatagatgtggttccacctaatgtcagggaccttctggatattttacgggaaagaggtaagctgtctgtcggggacttggctgaactgctctacagagtgaggcgatttgacctgctcaaacgtatcttgaagatggacagaaaagctgtggagacccacctgctcaggaaccctcaccttgtttcggactatagagtgctgatggcagagattggtgaggatttggataaatctgatgtgtcctcattaattttcctcatgaaggattacatgggccgaggcaagataagcaaggagaagagtttcttggaccttgtggttgagttggagaaactaaatctggttgccccagatcaactggatttattagaaaaatgcctaaagaacatccacagaatagacctgaagacaaaaatccagaagtacaagcagtctgttcaaggagcagggacaagttacaggaatgttctccaagcagcaatccaaaagagtctcaaggat

SEQ ID NO: 112 - DNA, 903 bp, Artificial Sequence
  Synthetic Polynucleotide
atgactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacacca

SEQ ID NO: 113 - DNA, 1224 bp, Artificial Sequence
  Synthetic Polynucleotide
atgggcgtccaagtcgaaaccattagtcccggcgatggcagaacatttcctaaaaggggacaaacatgtgtcgtccattatacaggcatgttggaggacggcaaaaaggtggacagtagtagagatcgcaataaacctttcaaattcatgttgggaaaacaagaagtcattaggggatgggaggagggcgtggctcaaatgtccgtcggccaacgcgctaagctcaccatcagccccgactacgcatacggcgctaccggacatcccggaattattccccctcacgctaccttggtgtttgacgtcgaactgttgaagctcgggactagaggagtgcaggtggagactatctccccaggagacgggcgcaccttccccaagcgcggccagacctgcgtggtgcactacaccgggatgcttgaagatggaaagaaagttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaagggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacacca

SEQ ID NO: 114 - DNA, 1059 bp, Artificial Sequence
  Synthetic Polynucleotide
atggcccatttcccagggtttggacagagtcttcttttcggatacccagtctacgtgtttggagactgtgtacaaggcgactggtgccccatctctgggggactatgttcggcccgcctacatcgtcacgccctactggccacctgtccagagcatcagatcacctgggaccccatcgacggacgcgttatcggctcagctctacagttccttatccctcgactcccctccttccccacccagagaacctctaagaccctcaaggtccttaccccgccaatcactcatacaacccccaacattccaccctccttcctccaggccatgcgcaaatactcccccttccgaaatggatacatggaacccacccttgggcagcacctcccaaccctgtcttttccagaccccggactccggccccaaaacctgtacaccctctggggaggctccgttgtctgcatgtacctctaccagctttccccccccatcacctggcccctcctgccccacgtgattttttgccaccccggccagctcggggccttcctcaccaatgttccctacaagcgaatagaagaactcctctataaaatttccctcaccacaggggccctaataattctacccgaagactgtttgcccaccacccttttccagcctgctagggcacccgtcacgctaacagcctggcaaaacggcctccttccgttccactcaaccctcaccactccaggccttatttggacatttaccgatggcacgcctatgatttccgggccctgccctaaagatggccagccatctttagtactacagtcctcctcctttatatttcacaaatttcaaaccaaggcctaccacccctcatttctactctcacacggcctcatacagtactcttcctttcatagtttacatctcctgtttgaagaatacaccaacatccccatttctctactttttaacgaaaaagaggcagatgacaatgaccatgagccccaaatatcccccgggggcttagagcctcccagtgaaaaacatttccgagaaacagaagtc

SEQ ID NO: 115 - DNA, 1068 bp, Artificial Sequence
  Synthetic Polynucleotide
atggcgcactttccgggctttggacagtcactcctgtacggctatcccgtctatgtattcggtgattgtgtgcaagccgattggtgtccagtgtccggtggtctgtgcagtacacggcttcaccggcacgccctgctggcaacttgccccgaacaccagcttacatgggacccaatcgacggtcgcgtagtgtcttctcccctccagtatctgattcctagattgccttcctttccaacacagaggaccagccggaccctgaaggttctgaccccaccgactacaccagtgtcccccaaagtgcctcccgccttcttccaaagtatgagaaaacatactccctataggaatggctgcttggagccaaccctcggtgaccaactcccctcactcgccttccccgaacctggcctgcgcccacagaacatctatactacttggggcaagactgtggtatgcctttacctgtaccagctgagtcccccgatgacatggcccctcatcccccacgtcattttctgtcacccacggcagctgggagcgttccttaccaaagttccgctcaaacgcctggaggaactgctgtataagatgtttctgcacactggtgccgtgatcgtgctgcccgaggacgatctgcccaccacaatgttccagccggtgcgggctccttgcatccagactgcttggtgcacaggccttctgccttaccactccatactcacaacccctggtctgatctggaccttcaatgacggaagccctatgatttcaggaccttgtcccaaggctggacagccatctctggttgtgcagtcatctctgctcatcttcgagaaattccaaaccaaggcctttcatccatcctacctcctctcccatcagctgatacagtacagctccttccacaacttgcacctgctctttgatgaatatacgaatattccagtcagcatactcttcaacaagggcgaggccgatgataatggcgaccagccgcctgagcctgccgcacagggtgaaagctccacacagaaggtgcggccctcccatactaacaatccaaag

SEQ ID NO: 116 - DNA, 1068 bp, Artificial Sequence
  Synthetic Polynucleotide
atggcgcactttccgggctttggacagtcactcctgtacggctatcccgtctatgtattcggtgattgtgtgcaagccgattggtgtccagtgtccggtggtctgtgcagtacacggcttcaccggcacgccctgctggcaacttgccccgaacaccagcttacatgggacccaatcgacggtcgcgtagtgtcttctcccctccagtatctgattcctagattgccttcctttccaacacagaggaccagccggaccctgaaggttctgaccccaccgactacaccagtgtcccccaaagtgcctcccgccttcttccaaagtatgagaaaacatactccctataggaatggctgcttggagccaaccctcggtgaccaactcccctcactcgccttccccgaacctggcctgcgcccacagaacatctatactacttggggcaagactgtggtatgcctttacctgtaccagctgagtcccccgatgacatggcccctcatcccccacgtcattttctgtcacccacggcagctgggagcgttccttaccaaagttccgctcaaacgcctggaggaactgctgtataagatgtttctgcacactggtgccgtgatcgtgctgcccgaggacgatctgcccaccacaatgttccagccggtgcgggctccttgcatccagactgcttggtgcacaggccttctgccttaccactccatactcacaacccctggtctgatctggaccttcaatgacggaagccctatgatttcaggaccttgtcccaaggctggacagccatctctggttgtgcagtcatctctgctcatcttcgagaaattccaaaccaaggcctttcatccatcctacctcctctcccatcagctgatacagtacagctccttccacaacttgcacctgctctttgatgaatatacgaatattccagtcagcagaagcttcaacaagggcgaggccgatgataatggcgaccagccgcctgagcctgccgcacagggtgaaagctccacacagaaggtgcggccctcccatactaacaatccaaag

SEQ ID NO: 117 - DNA, 1200 bp, Artificial Sequence
  Synthetic Polynucleotide
atgctggaaggcgtgcaggtggaaaccatcagccctggcgacggcagaaccttccctaagaggggccagacctgcgtggtgcactacaccggaatgctggaagatggcaagaaggtggacagcagccgggaccggaacaagcccttcaagttcatgctgggcaagcaggaagtgatccggggctgggaagagggcgtggcccagatgtctgtgggccagagagccaagctgaccatctcccccgattacgcctacggcgctacaggccaccctggcatcattcctccacacgccacactggtgttcgacgtggaactgctgaagctggaaagcggcggaggcagcggagtggatggcttcggagatgtgggagccctggaaagcctgagaggcaacgccgacctggcctacatcctgagcatggaaccttgcggccactgcctgattatcaacaacgtgaacttctgccgcgagagcggcctgagaaccagaaccggcagcaacatcgactgcgagaagctgcggcggagattcagcagcctgcacttcatggtggaagtgaagggcgacctgaccgccaagaaaatggtgctggccctgctggaactggcccagcaggatcatggcgctctggactgctgtgtggtcgtgatcctgagccacggctgccaggcttcccatcttcagttccctggcgctgtgtacggcaccgatggctgtcctgtgtccgtggaaaagatcgtgaacatcttcaacggcaccagctgccccagcctgggcggaaagcccaagctgttctttattcaagcctgtggcggcgagcagaaggaccacggctttgaggtggcctccaccagccctgaggatgagagccctggcagcaaccctgagcctgacgccaccccattccaggaaggactgcggaccttcgaccagctggacgccatctctagcctgcccacccccagcgacatcttcgtgtcctacagcaccttccccggctttgtgtcctggcgggaccctaagagcggctcttggtacgtggaaaccctggacgacatctttgagcagtgggctcacagcgaggacctccagagcctgctgctgagagtggctaacgccgtgtccgtgaagggcatctacaagcagatgcctggctgcttcaacttcctgcggaagaagctgtttttcaagaccagc

SEQ ID NO: 118 - DNA, 576 bp, Artificial Sequence
  Synthetic Polynucleotide
atggaaaaccgctggcaagtgatgatcgtgtggcaggttgaccggatgcggatcagaacctggaagtccctggtcaagcaccacatgtacgtgtccggcaaggccagaggctggttctacagacaccactacgagagccctcatcctcggatcagcagcgaggtgcacatccctctgggagatgccagactggtcatcaccacatactggggcctgcacaccggcgagagagattggcatcttggacagggcgtgtccatcgagtggcggaagaagagatacagcacccaggtggaccctgagctggccgatcaactgatccacctgtactacttcgactgcttcagcgacagcgccatcagaaaggccctgctgggacacatcgtgtctcccagatgtgaataccaggccggccacaacaaagtgggcagcctgcaatatctggccctggccgctctgattacccctaagaagatcaagcctcctctgcctagcgtgaccaagctgaccgaggacagatggaacaagccccagaaaacaaagggccacagaggcagccacaccatgaacggacat

SEQ ID NO: 119 - DNA, 2000 bp, Artificial Sequence
  Synthetic Polynucleotide
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 120 - DNA, 1358 bp, Artificial Sequence
  Synthetic Polynucleotide
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 121 - DNA, 5016 bp, Artificial Sequence
  Synthetic Polynucleotide
tttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttt

SEQ ID NO: 122 - DNA, 2400 bp, Artificial Sequence
  Synthetic Polynucleotide
tttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttttt

SEQ ID NO: 123 - DNA, 10 bp, Artificial Sequence
  Synthetic Polynucleotide
aaacaaacac

SEQ ID NO: 124 - DNA, 10 bp, Artificial Sequence
  Synthetic Polynucleotide
aaacaagggt

SEQ ID NO: 125 - DNA, 10 bp, Artificial Sequence
  Synthetic Polynucleotide
aaacatctct

SEQ ID NO: 126 - DNA, 10 bp, Artificial Sequence
  Synthetic Polynucleotide
aaaccctgac

SEQ ID NO: 127 - DNA, 10 bp, Artificial Sequence
  Synthetic Polynucleotide
aaacgggaac

SEQ ID NO: 128 - DNA, 10 bp, Artificial Sequence
  Synthetic Polynucleotide
aaagacagta

SEQ ID NO: 129 - DNA, 7488 bp, Artificial Sequence
  Synthetic Polynucleotide
  misc_feature (3291)..(3294): n is a, c, g, or t
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcnnnngtcgactccggatgatcagggccctgtacagatatcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 130 - DNA, 6887 bp, Artificial Sequence
  Synthetic Polynucleotide
  misc_feature (3291)..(3294): n is a, c, g, or t
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcnnnngtcgacggcgaatccggactatagtgtcacctaaatgctagacgtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 131 - DNA, 5150 bp, Artificial Sequence
  Synthetic Polynucleotide
tgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtattcccaataaagcctcttgctgtttgcatccgaatcgtggactcgctgatccttgggagggtctcctcagattgattgactgcccacctcgggggtctttcatttggaggttccaccgagatttggagacccctgcccagggaccaccgacccccccgccgggaggtaagctggccagcggtcgtttcgtgtctgtctctgtctttgtgcgtgtttgtgccggcatctaatgtttgcgcctgcgtctgtactagttagctaactagctctgtatctggcggacccgtggtggaactgacgagttctgaacacccggccgcaaccctgggagacgtcccagggactttgggggccgtttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagcgctgcagcatcgttctgtgttgtctctgtctgactgtgtttctgtatttgtctgaaaattagggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgccggaattagatctcctaggatccaagaattcggctcgagttcgaagggacgcgtaatgtcgacatcgataaaataaaagattttatttagtctccagaaaaaggggggaatgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtgtatccaataaaccctcttgcagttgcatccgacttgtggtctcgctgttccttgggagggtctcctctgagtgattgactacccgtcagcgggggtctttcatgggtaacagtttcttgaagttggagaacaacattctgagggtaggagtcgaatattaagtaatcctgactcaattagccactgttttgaatccacatactccaatactcctgaaatagttcattatggacagcgcagaagagctggggagaattaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggcgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggcgattagtccaatttgttaaagacaggatatcagtggtccaggctctagttttgactcaacaatatcaccagctgaagcctatagagtacgagccatagataaaataaaagattttatttagtctccagaaaaaggggggaa

SEQ ID NO: 132 - DNA, 7764 bp, Artificial Sequence
  Synthetic Polynucleotide
tgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtattcccaataaagcctcttgctgtttgcatccgaatcgtggactcgctgatccttgggagggtctcctcagattgattgactgcccacctcgggggtctttcatttggaggttccaccgagatttggagacccctgcccagggaccaccgacccccccgccgggaggtaagctggccagcggtcgtttcgtgtctgtctctgtctttgtgcgtgtttgtgccggcatctaatgtttgcgcctgcgtctgtactagttagctaactagctctgtatctggcggacccgtggtggaactgacgagttctgaacacccggccgcaaccctgggagacgtcccagggactttgggggccgtttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagcgctgcagcatcgttctgtgttgtctctgtctgactgtgtttctgtatttgtctgaaaattagggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgccggaattagatctcctagcaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggagcagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgagtcgacatcgataaaataaaagattttatttagtctccagaaaaaggggggaatgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtgtatccaataaaccctcttgcagttgcatccgacttgtggtctcgctgttccttgggagggtctcctctgagtgattgactacccgtcagcgggggtctttcatgggtaacagtttcttgaagttggagaacaacattctgagggtaggagtcgaatattaagtaatcctgactcaattagccactgttttgaatccacatactccaatactcctgaaatagttcattatggacagcgcagaagagctggggagaattaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggcgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggcgattagtccaatttgttaaagacaggatatcagtggtccaggctctagttttgactcaacaatatcaccagctgaagcctatagagtacgagccatagataaaataaaagattttatttagtctccagaaaaaggggggaa

SEQ ID NO: 133 - DNA, 5857 bp, Artificial Sequence
  Synthetic Polynucleotide
aattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggatccctatacagttgaagtcggaagtttacatacaccttagccaaatacatttaaactcactttttcacaattcctgacatttaatcctagtaaaaattccctgtcttaggtcagttaggatcaccactttattttaagaatgtgaaatatcagaataatagtagagagaatgattcatttcagcttttatttctttcatcacattcccagtgggtcagaagtttacatacactcgactcctctgcagaatgcggcgatgtttcggtaaggggtcccgagtagctagttcatggcagccagcatatggcatatgttgccaaactctaaaccaaatactcattctgatgttttaaatgatttgccctcccatatgtccttccgagtgagagacacaaaaaattccaacacactattgcaatgaaaataaatttcctttattagccagaagtcagatgctcaaggggcttcatgatgtccccataatttttggcagagggaaaaagatctcagtggtatttgtgagccagggcattggccacaccagccaccaccttctgataggcagcctgcacctgaggagtgaattcacgacaggccttcgaatcaggcaccgggcttgcgggtcatgcaccaggtgcgcggtccttcgggcacctcgacgtcggcggtgacggtgaagccgagccgctcgtagaaggggaggttgcggggcgcggaggtctccaggaaggcgggcaccccggcgcgctcggccgcctccactccggggagcacgacggcgctgcccagacccttgccctggtggtcgggcgagacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcctcaggtgcagaggtttctacagggaaagagagaaaggctacagttagtttgctgtgatgatgctaagtgccgaggtcagatgtctatggattgtacacggaatcccaacgcaggaaccaaaaaacactcacccaaaaaaatggcgctaaggccgagagaaaggcgaagttccgtctacggctatataccttgaaacaggggcggcagaagtgacgcaacgcggttgcgcggacggcttcctgtgttttcattggtcgaagcgttctgcgcgtgcgcagagattccccagggaaggcgggccctcttccgaatgtccaatccggacattcttccggttggacctccgcggtcagcgctgtgcccggcgagagatcacgtggggcgcggaggcggtgctgctggggcacggccgtccagcctcggcggccatatttttgaggggctgttcatctcgttcacacgctctgtccgccatgtttgtgagtggaagcgccattaccccttcaagcgactgaaggctgcagggcctctggtggcccgcatggggagaccagacccgccaggcccgcctttccgcactcagtccgggcttactttattttgtgagacagggtctcgcctagaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcttggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccatactgagtgggtggagactgaagttaggccagcttggcacttgatgtaattctccttggaatttgccctttttgagtttggatcttggttcattctcaagcctcagacagtggttcaaagtttttttcttccatttaaggtgtcgtgaaaactaccccaagctggcctctgaggccaccatggctcgagtttcgaactcaattatactgaattgtttcatcatagggttcaacattgtgataaatcaggacttcaatgtctagtgttcagtaaataccttgtagggctctccaaaaaggggaatcttttcaggaaatgcctctttctcttggtgggcttcctggttgcgtctttccttctctctaattcgaaggcctgtcaggccaagcttggggatcaattctctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctgggcctactagatagcggaccccttaccgaaacatcgccgcattctgcagaggagtcgaacttagtgtatgtaaacttctgacccactggaattgtgatacagtgaattataagtgaaataatctgtctgtaaacaattgttggaaaaatgacttgtgtcatgcacaaagtagatgtcctaactgacttgccaaaactattgtttgttaacaagaaatttgtggagtagttgaaaaacgagttttaatgactccaacttaagtgtatgtaaacttccgacttcaactgtatagggatcc

SEQ ID NO: 134 - DNA, 7735 bp, Artificial Sequence
  Synthetic Polynucleotide
aattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggatccctatacagttgaagtcggaagtttacatacaccttagccaaatacatttaaactcactttttcacaattcctgacatttaatcctagtaaaaattccctgtcttaggtcagttaggatcaccactttattttaagaatgtgaaatatcagaataatagtagagagaatgattcatttcagcttttatttctttcatcacattcccagtgggtcagaagtttacatacactcgactcctctgcagaatgcggcgatgtttcggtaaggggtcccgagtagctagttcatggcagccagcatatggcatatgttgccaaactctaaaccaaatactcattctgatgttttaaatgatttgccctcccatatgtccttccgagtgagagacacaaaaaattccaacacactattgcaatgaaaataaatttcctttattagccagaagtcagatgctcaaggggcttcatgatgtccccataatttttggcagagggaaaaagatctcagtggtatttgtgagccagggcattggccacaccagccaccaccttctgataggcagcctgcacctgaggagtgaattcacgacaggccttcgaatcaggcaccgggcttgcgggtcatgcaccaggtgcgcggtccttcgggcacctcgacgtcggcggtgacggtgaagccgagccgctcgtagaaggggaggttgcggggcgcggaggtctccaggaaggcgggcaccccggcgcgctcggccgcctccactccggggagcacgacggcgctgcccagacccttgccctggtggtcgggcgagacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcctcaggtgcagaggtttctacagggaaagagagaaaggctacagttagtttgctgtgatgatgctaagtgccgaggtcagatgtctatggattgtacacggaatcccaacgcaggaaccaaaaaacactcacccaaaaaaatggcgctaaggccgagagaaaggcgaagttccgtctacggctatataccttgaaacaggggcggcagaagtgacgcaacgcggttgcgcggacggcttcctgtgttttcattggtcgaagcgttctgcgcgtgcgcagagattccccagggaaggcgggccctcttccgaatgtccaatccggacattcttccggttggacctccgcggtcagcgctgtgcccggcgagagatcacgtggggcgcggaggcggtgctgctggggcacggccgtccagcctcggcggccatatttttgaggggctgttcatctcgttcacacgctctgtccgccatgtttgtgagtggaagcgccattaccccttcaagcgactgaaggctgcagggcctctggtggcccgcatggggagaccagacccgccaggcccgcctttccgcactcagtccgggcttactttattttgtgagacagggtctcgcctagaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctgggcctactagatagcggaccccttaccgaaacatcgccgcattctgcagaggagtcgaacttagtgtatgtaaacttctgacccactggaattgtgatacagtgaattataagtgaaataatctgtctgtaaacaattgttggaaaaatgacttgtgtcatgcacaaagtagatgtcctaactgacttgccaaaactattgtttgttaacaagaaatttgtggagtagttgaaaaacgagttttaatgactccaacttaagtgtatgtaaacttccgacttcaactgtatagggatcc

SEQ ID NO: 135 - DNA, 7780 bp, Artificial Sequence
  Synthetic Polynucleotide
aattttaacaaaatattaacgcttacaatttcctgatgcggtattttctccttacgcatctgtgcggtatttcacaccgcatcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggatccctatacagttgaagtcggaagtttacatacaccttagccaaatacatttaaactcactttttcacaattcctgacatttaatcctagtaaaaattccctgtcttaggtcagttaggatcaccactttattttaagaatgtgaaatatcagaataatagtagagagaatgattcatttcagcttttatttctttcatcacattcccagtgggtcagaagtttacatacactcgactcctctgcagaatgcggcgatgtttcggtaaggggtcccgagtagctagttcatggcagccagcatatggcatatgttgccaaactctaaaccaaatactcattctgatgttttaaatgatttgccctcccatatgtccttccgagtgagagacacaaaaaattccaacacactattgcaatgaaaataaatttcctttattagccagaagtcagatgctcaaggggcttcatgatgtccccataatttttggcagagggaaaaagatctcagtggtatttgtgagccagggcattggccacaccagccaccaccttctgataggcagcctgcacctgaggagtgaattcacgacaggccttcgaatcaggcaccgggcttgcgggtcatgcaccaggtgcgcggtccttcgggcacctcgacgtcggcggtgacggtgaagccgagccgctcgtagaaggggaggttgcggggcgcggaggtctccaggaaggcgggcaccccggcgcgctcggccgcctccactccggggagcacgacggcgctgcccagacccttgccctggtggtcgggcgagacgccgacggtggccaggaaccacgcgggctccttgggccggtgcggcgccaggaggccttccatctgttgctgcgcggccagccgggaaccgctcaactcggccatgcgcgggccgatctcggcgaacaccgcccccgcttcgacgctctccggcgtggtccagaccgccaccgcggcgccgtcgtccgcgacccacaccttgccgatgtcgagcccgacgcgcgtgaggaagagttcttgcagctcggtgacccgctcgatgtggcggtccggatcgacggtgtggcgcgtggcggggtagtcggcgaacgcggcggcgagggtgcgtacggccctggggacgtcgtcgcgggtggcgaggcgcaccgtgggcttgtactcggtcatggtggcctcaggtgcagaggtttctacagggaaagagagaaaggctacagttagtttgctgtgatgatgctaagtgccgaggtcagatgtctatggattgtacacggaatcccaacgcaggaaccaaaaaacactcacccaaaaaaatggcgctaaggccgagagaaaggcgaagttccgtctacggctatataccttgaaacaggggcggcagaagtgacgcaacgcggttgcgcggacggcttcctgtgttttcattggtcgaagcgttctgcgcgtgcgcagagattccccagggaaggcgggccctcttccgaatgtccaatccggacattcttccggttggacctccgcggtcagcgctgtgcccggcgagagatcacgtggggcgcggaggcggtgctgctggggcacggccgtccagcctcggcggccatatttttgaggggctgttcatctcgttcacacgctctgtccgccatgtttgtgagtggaagcgccattaccccttcaagcgactgaaggctgcagggcctctggtggcccgcatggggagaccagacccgccaggcccgcctttccgcactcagtccgggcttactttattttgtgagacagggtctcgcctagaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcaccatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagatagctgatcacctaaggtacctagcctaggtaagtcgacactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctgggcctactagatagcggaccccttaccgaaacatcgccgcattctgcagaggagtcgaacttagtgtatgtaaacttctgacccactggaattgtgatacagtgaattataagtgaaataatctgtctgtaaacaattgttggaaaaatgacttgtgtcatgcacaaagtagatgtcctaactgacttgccaaaactattgtttgttaacaagaaatttgtggagtagttgaaaaacgagttttaatgactccaacttaagtgtatgtaaacttccgacttcaactgtatagggatcc

SEQ ID NO: 136 - DNA, 1183 bp, Artificial Sequence
  Synthetic Polynucleotide
gtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtga

SEQ ID NO: 137 - DNA, 20 bp, Artificial Sequence
  Synthetic Polynucleotide
taatacgactcactataggg

SEQ ID NO: 138 - DNA, 20 bp, Artificial Sequence
  Synthetic Polynucleotide
attaaccctcactaaaggga

SEQ ID NO: 139 - DNA, 9541 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctagttaagcttgatatcgaattcctgcagcccgggggatctgctagcatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggtcaaggaacctcagtcaccgtctcctcacgcgtaggaggcagtggtgtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccgtatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgagttggaaggatgcctctggatggtcctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgagtcgactccggatgatcagggccctgtacagatatcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 140 - DNA, 7566 bp, Artificial Sequence
  Synthetic Polynucleotide
tgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtattcccaataaagcctcttgctgtttgcatccgaatcgtggactcgctgatccttgggagggtctcctcagattgattgactgcccacctcgggggtctttcatttggaggttccaccgagatttggagacccctgcccagggaccaccgacccccccgccgggaggtaagctggccagcggtcgtttcgtgtctgtctctgtctttgtgcgtgtttgtgccggcatctaatgtttgcgcctgcgtctgtactagttagctaactagctctgtatctggcggacccgtggtggaactgacgagttctgaacacccggccgcaaccctgggagacgtcccagggactttgggggccgtttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagcgctgcagcatcgttctgtgttgtctctgtctgactgtgtttctgtatttgtctgaaaattagggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgccggaattagatccccaccatgaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagaccgatttctacccctacgatgtgcccgattacgcttagtctagagggccctattctatagtgtcacctaagtcgaggttaacgaattctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgacctgcatcccgccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccggggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagagtagatgccgaccgaacaagagctgatttcgagaacgcctcagccagcaactcgcgcgagcctagcaaggcaaatgcgagagaacggccttacgcttggtggcacagttctcgtccacagttcgctaagctcgctcggctgggtcgcgggagggccggtcgcagtgattcaggcccttctggattgtgttggtccccagggcacgattgtcatgcccacgcactcgggtgatctgactgatcccgcagattggagatcgccgcccgtgcctgccgattgggtgcagatccgtcgacctgcagccaagcttatcgataaaataaaagattttatttagtctccagaaaaaggggggaatgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtgtatccaataaaccctcttgcagttgcatccgacttgtggtctcgctgttccttgggagggtctcctctgagtgattgactacccgtcagcgggggtctttcatgggtaacagtttcttgaagttggagaacaacattctgagggtaggagtcgaatattaagtaatcctgactcaattagccactgttttgaatccacatactccaatactcctgaaatagttcattatggacagcgcagaagagctggggagaattaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggcgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggcgattagtccaatttgttaaagacaggatatcagtggtccaggctctagttttgactcaacaatatcaccagctgaagcctatagagtacgagccatagataaaataaaagattttatttagtctccagaaaaaggggggaa

SEQ ID NO: 141 - DNA, 6884 bp, Artificial Sequence
  Synthetic Polynucleotide
tgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtattcccaataaagcctcttgctgtttgcatccgaatcgtggactcgctgatccttgggagggtctcctcagattgattgactgcccacctcgggggtctttcatttggaggttccaccgagatttggagacccctgcccagggaccaccgacccccccgccgggaggtaagctggccagcggtcgtttcgtgtctgtctctgtctttgtgcgtgtttgtgccggcatctaatgtttgcgcctgcgtctgtactagttagctaactagctctgtatctggcggacccgtggtggaactgacgagttctgaacacccggccgcaaccctgggagacgtcccagggactttgggggccgtttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagcgctgcagcatcgttctgtgttgtctctgtctgactgtgtttctgtatttgtctgaaaattagggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgatcctccctttatccagccctcactccttctctaggcgccggaattagatccccaccatgaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagaccgatttctacccctacgatgtgcccgattacgcttagtctagagggccctattctatagtgtcacctaagtcgaggttaacgaattctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgacctgcagcccaagcttaccatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgcccgccccacgacccgcagcgcccgaccgaaaggagcgcacgaccccatgcatcgataaaataaaagattttatttagtctccagaaaaaggggggaatgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtgtatccaataaaccctcttgcagttgcatccgacttgtggtctcgctgttccttgggagggtctcctctgagtgattgactacccgtcagcgggggtctttcatgggtaacagtttcttgaagttggagaacaacattctgagggtaggagtcgaatattaagtaatcctgactcaattagccactgttttgaatccacatactccaatactcctgaaatagttcattatggacagcgcagaagagctggggagaattaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggcgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggcgattagtccaatttgttaaagacaggatatcagtggtccaggctctagttttgactcaacaatatcaccagctgaagcctatagagtacgagccatagataaaataaaagattttatttagtctccagaaaaaggggggaa

SEQ ID NO: 142 - DNA, 7512 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgataagcttgggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgactctagaggatccccaccatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccctatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgagttggaaggatgcctctggatggtcttaagtcgagaccgatttctacccctacgatgtgcccgattacgcttagtctagagggcccgcggttcgaaggtaagcctatccctaaccctctcctcggtctcgattctacgcgtaccggttagtaatgagtttggaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 143 - DNA, 7476 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgataagcttgggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgactctagaggatccccatggaagccgaggccgagagaggcaagctgcccggcaaaaagctgcccctggaagtgctgatcgagctggaagccaacgccagaaaggccggctgcaccagaggctgcctgatctgcctgagcaagatcaagtgcaccgccaagatgaagaagtacatccccggcagatgcgccgactacggcggcgataagaaaacaggccaggccggcatcgtgggagccatcgtggatatccctgagatcagcggcttcaaagaaatggaacccatggaacagtttatcgcccaggtggaccgctgcgccgattgcacaacaggctgtctgaagggcctggctaacgtgaagtgcagcgacctgctgaagaagtggctgcctggcagatgtgccaccttcgccgacaagatccagagcgaggtggacaacatcaagggactggccggcgacctcgagaccgatttctacgactacaaggacgacgatgacaaggattataaagatgatgacgataaagtcgagaccgatttctacgactacaaggacgacgatgacaagtagtctagagggcccgcggttcgaaggtaagcctatccctaaccctctcctcggtctcgattctacgcgtaccggttagtaatgagtttggaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 144 - DNA, 8663 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctagttaagcttgatatcgaattcctgcagcccgggggatctgctagcatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgccactagtggctccggcgagggcagaggaagtctactaacctgcggagatgtggaagaaaatcctggcccacatatgaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgactaactcgactccggatgatcagggccctgtacagatatcgacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 145 - DNA, 7524 bp, Artificial Sequence
  Synthetic Polynucleotide
tgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtattcccaataaagcctcttgctgtttgcatccgaatcgtggactcgctgatccttgggagggtctcctcagattgattgactgcccacctcgggggtctttcatttggaggttccaccgagatttggagacccctgcccagggaccaccgacccccccgccgggaggtaagctggccagcggtcgtttcgtgtctgtctctgtctttgtgcgtgtttgtgccggcatctaatgtttgcgcctgcgtctgtactagttagctaactagctctgtatctggcggacccgtggtggaactgacgagttctgaacacccggccgcaaccctgggagacgtcccagggactttgggggccgtttttgtggcccgacctgaggaagggagtcgatgtggaatccgaccccgtcaggatatgtggttctggtaggagacgagaacctaaaacagttcccgcctccgtctgaatttttgctttcggtttggaaccgaagccgcgcgtcttgtctgctgcagcgctgcagcatcgttctgtgttgtctctgtctgactgtgtttctgtatttgtctgaaaattagggccagactgttaccactcccttaagtttgaccttaggtcactggaaagatgtcgagcggatcgctcacaaccagtcggtagatgtcaagaagagacgttgggttaccttctgctctgcagaatggccaacctttaacgtcggatggccgcgagacggcacctttaaccgagacctcatcacccaggttaagatcaaggtcttttcacctggcccgcatggacacccagaccaggtcccctacatcgtgacctgggaagccttggcttttgacccccctccctgggtcaagccctttgtacaccctaagcctccgcctcctcttcctccatccgccccgtctctcccccttgaacctcctcgttcgaccccgcctcgtatcctccctttatccagccctcactccttctctaggcgccggaattagatccccaccatggtcttcacactcgaagatttcgttggggactggcgacagacagccggctacaacctggaccaagtccttgaacagggaggtgtgtccagtttgtttcagaatctcggggtgtccgtaactccgatccaaaggattgtcctgagcggtgaaaatgggctgaagatcgacatccatgtcatcatcccgtatgaaggtctgagcggcgaccaaatgggccagatcgaaaaaatttttaaggtggtgtaccctgtggatgatcatcactttaaggtgatcctgcactatggcacactggtaatcgacggggttacgccgaacatgatcgactatttcggacggccctatgaaggcatcgccgtgttcgacggcaaaaagatcactgtaacagggaccctgtggaacggcaacaaaattatcgacgagcgcctgatcaaccccgacggctccctgctgttccgagtaaccatcaacggagtgaccggctggcggctgtgcgaacgcattctggcgagttggaaggatgcctctggatggtcttaagtcgaggttaacgaattctaccgggtaggggaggcgcttttcccaaggcagtctggagcatgcgctttagcagccccgctgggcacttggcgctacacaagtggcctctggcctcgcacacattccacatccaccggtaggcgccaaccggctccgttctttggtggccccttcgcgccaccttctactcctcccctagtcaggaagttcccccccgccccgcagctcgcgtcgtgcaggacgtgacaaatggaagtagcacgtctcactagtctcgtgcagatggacagcaccgctgagcaatggaagcgggtaggcctttggggcagcggccaatagcagctttgctccttcgctttctgggctcagaggctgggaaggggtgggtccgggggcgggctcaggggcgggctcaggggcggggcgggcgcccgaaggtcctccggaggcccggcattctgcacgcttcaaaagcgcacgtctgccgcgctgttctcctcttcctcatctccgggcctttcgacctgcatcccgccaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagagtagatgccgaccgaacaagagctgatttcgagaacgcctcagccagcaactcgcgcgagcctagcaaggcaaatgcgagagaacggccttacgcttggtggcacagttctcgtccacagttcgctaagctcgctcggctgggtcgcgggagggccggtcgcagtgattcaggcccttctggattgtgttggtccccagggcacgattgtcatgcccacgcactcgggtgatctgactgatcccgcagattggagatcgccgcccgtgcctgccgattgggtgcagatccgtcgacctgcagccaagcttatcgataaaataaaagattttatttagtctccagaaaaaggggggaatgaaagaccccacctgtaggtttggcaagctagcttaagtaacgccattttgcaaggcatggaaaatacataactgagaatagagaagttcagatcaaggttaggaacagagagacagcagaatatgggccaaacaggatatctgtggtaagcagttcctgccccggctcagggccaagaacagatggtccccagatgcggtcccgccctcagcagtttctagagaaccatcagatgtttccagggtgccccaaggacctgaaatgaccctgtgccttatttgaactaaccaatcagttcgcttctcgcttctgttcgcgcgcttctgctccccgagctcaataaaagagcccacaacccctcactcggcgcgccagtcctccgatagactgcgtcgcccgggtacccgtgtatccaataaaccctcttgcagttgcatccgacttgtggtctcgctgttccttgggagggtctcctctgagtgattgactacccgtcagcgggggtctttcatgggtaacagtttcttgaagttggagaacaacattctgagggtaggagtcgaatattaagtaatcctgactcaattagccactgttttgaatccacatactccaatactcctgaaatagttcattatggacagcgcagaagagctggggagaattaattcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtctaagaaaccattattatcatgacattaacctataaaaataggcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggcgcaaggaatggtgcatgcaaggagatggcgcccaacagtcccccggccacggggcctgccaccatacccacgccgaaacaagcgctcatgagcccgaagtggcgagcccgatcttccccatcggtgatgtcggcgatataggcgccagcaaccgcacctgtggcgccggtgatgccggccacgatgcgtccggcgtagaggcgattagtccaatttgttaaagacaggatatcagtggtccaggctctagttttgactcaacaatatcaccagctgaagcctatagagtacgagccatagataaaataaaagattttatttagtctccagaaaaagggggga

SEQ ID NO: 146 - DNA, 7476 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgataagcttgggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgactctagaggatccccaccatgaagcccaccgagaacaacgaagacttcaacatcgtggccgtggccagcaacttcgcgaccacggatctcgatgctgaccgcgggaagttgcccggcaagaagctgccgctggaggtgctcaaagagatggaagccaatgcccggaaagctggctgcaccaggggctgtctgatctgcctgtcccacatcaagtgcacgcccaagatgaagaagttcatcccaggacgctgccacacctacgaaggcgacaaagagtccgcacagggcggcataggcgaggcgatcgtcgacattcctgagattcctgggttcaaggacttggagcccatggagcagttcatcgcacaggtcgatctgtgtgtggactgcacaactggctgcctcaaagggcttgccaacgtgcagtgttctgacctgctcaagaagtggctgccgcaacgctgtgcgacctttgccagcaagatccagggccaggtggacaagatcaagggggccggtggtgacctcgagaccgatttctacgactacaaggacgacgatgacaagtagtctagagggcccgcggttcgaaggtaagcctatccctaaccctctcctcggtctcgattctacgcgtaccggttagtaatgagtttggaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 147 - DNA, 223 bp, Artificial Sequence
  Synthetic Polynucleotide
gaacgctgacgtcatcaacccgctccaaggaatcgcgggcccagtgtcactaggcgggaacacccagcgcgcgtgcgccctggcaggaagatggctgtgagggacaggggagtggcgccctgcaatatttgcatgtcgctatgtgttctgggaaatcaccataaacgtgaaatgtctttggatttgggaatcttataagttctgtatgagaccactctttccc

SEQ ID NO: 148 - DNA, 278 bp, Artificial Sequence
  Synthetic Polynucleotide
gaacgctgacgtcatcaacccgctccaaggaatcgcgggcccagtgtcactaggcgggaacacccagcgcgcgtgcgccctggcaggaagatggctgtgagggacaggggagtggcgccctgcaatatttgcatgtcgctatgtgttctgggaaatcaccataaacgtgaaatgtctttggatttgggaatcttataagttctgtatgagaccactctttccctgaacctccctgattactatatcaagagtatagtaatcagggaggttcatttttt

SEQ ID NO: 149 - DNA, 7158 bp, Artificial Sequence
  Synthetic Polynucleotide
  misc_feature (3291)..(3294): n is a, c, g, or t
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcnnnngtcgacgaacgctgacgtcatcaacccgctccaaggaatcgcgggcccagtgtcactaggcgggaacacccagcgcgcgtgcgccctggcaggaagatggctgtgagggacaggggagtggcgccctgcaatatttgcatgtcgctatgtgttctgggaaatcaccataaacgtgaaatgtctttggatttgggaatcttataagttctgtatgagaccactctttccctgaacctccctgattactatatcaagagtatagtaatcagggaggttcattttttccggactatagtgtcacctaaatgctagacgtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 150 - DNA, 9803 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaagtacctgaactggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgagtcgacgaacgctgacgtcatcaacccgctccaaggaatcgcgggcccagtgtcactaggcgggaacacccagcgcgcgtgcgccctggcaggaagatggctgtgagggacaggggagtggcgccctgcaatatttgcatgtcgctatgtgttctgggaaatcaccataaacgtgaaatgtctttggatttgggaatcttataagttctgtatgagaccactctttccctgaacctccctgattactatatcaagagtatagtaatcagggaggttcattttttccggactatagtgtcacctaaatgctagacgtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 151 - DNA, 9571 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattggctagcaccatggccttaccagtgaccgccttgctcctgccgctggccttgctgctccacgccgccaggccggaacagaaactcatcagtgaagaagacctggaattccaggctgtcgtgacacagcctcctagcgcctctggcacaccaggccagagagtgaccatctcctgtagcggcagcagcagcaacatcggcagcaacaccgtgaactggtatcagcaggtgcccggcaccgctcccaagctgctgatctacagcaacaaccagcggcccagcggcgtgcccgatagattttctggcagcaagagcggcaccagcgccagcctggctatctctggactccagtccgaggacgaggccgactactattgcgccgcctgggacgatagcctgaacggctgggtgttcggcggaggcaccaagctgacagtgctgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatgcaactggtgcagagcggagccgaagtgaaagagcctggcgagagcctgcggatctcctgcaagggcagcggctacagcttcaccaatttctggatctcttgggtgcgccagatgcccggcaagggcctggaatggatgggcagagtggaccccggctactcctacagcacctacagccctagcttccagggccacgtgaccatcagcgccgacaagagcaccagcaccgcctacctccagtggaacagcctgaaggccagcgacaccgccatgtactactgcgccagagtgcagtacagcggctattacgattggttcgacccctggggccagggcacactcgtgacagtgtcaagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgagtcgacggcgaatccggactatagtgtcacctaaatgctagacgtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 152 - DNA, 9211 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcatggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgagtcgacggcgaatccggactatagtgtcacctaaatgctagacgtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 153 - DNA, 9214 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattcctgcagcccgggggatctgctagcatggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagtatggactggatttggcgcatccttttccttgtcggcgctgctaccggcgcgcattccttcgaagtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgagtcgacggcgaatccggactatagtgtcacctaaatgctagacgtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 154 - DNA, 9655 bp, Artificial Sequence
  Synthetic Polynucleotide
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcggttaacttttaaaagaaaaggggggattggggggtacagtgcaggggaaagaatagtagacataatagcaacagacatacaaactaaagaattacaaaaacaaattacaaaattcaaaattttatcgataagctttgcaaagatggataaagttttaaacagagaggaatctttgcagctaatggaccttctaggtcttgaaaggagtgcctcgtgaggctccggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgaccttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaggaattagcttggtactaatacgactcactatagggagacccaagctggctaggtaagcttgatatcgaattggctagcaccatggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgagtcgacggcgaatccggactatagtgtcacctaaatgctagacgtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 155 - DNA, 336 bp, Artificial Sequence
  Synthetic Polynucleotide
gatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaag

SEQ ID NO: 156 - DNA, 321 bp, Artificial Sequence
  Synthetic Polynucleotide
gatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaag

SEQ ID NO: 157 - DNA, 321 bp, Artificial Sequence
  Synthetic Polynucleotide
gatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaag

SEQ ID NO: 158 - DNA, 321 bp, Artificial Sequence
  Synthetic Polynucleotide
gatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcgg

SEQ ID NO: 159 - DNA, 321 bp, Artificial Sequence
  Synthetic Polynucleotide
caaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagaga

SEQ ID NO: 160 - DNA, 324 bp, Artificial Sequence
  Synthetic Polynucleotide
gacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagaga

SEQ ID NO: 161 - DNA, 318 bp, Artificial Sequence
  Synthetic Polynucleotide
gagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaa

SEQ ID NO: 162 - DNA, 333 bp, Artificial Sequence
  Synthetic Polynucleotide
gacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgcc

SEQ ID NO: 163 - DNA, 318 bp, Artificial Sequence
  Synthetic Polynucleotide
gacatccagatgacacagagccctagcagcctgtctgccagcgtgggagacagagtgaccatcacctgtagagccagcagcagcgtgggctacatgcactggtatcagcagaagcctggcaaggcccctaagctgctgatctacgccaccagcaatctggcctctggcgtgccaagcagattttccggctctggctacggcaccgacttcaccctgacaatatccagcctccagcctgaggacttcgccacctactactgccagcagtggtccagcgatcctcctacatttggcggaggcaccaaggtggaaatcaaa

SEQ ID NO: 164 - DNA, 333 bp, Artificial Sequence
  Synthetic Polynucleotide
gacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaag

SEQ ID NO: 165 - DNA, 321 bp, Artificial Sequence
  Synthetic Polynucleotide
gagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccagaacattcggccagggcaccaaggtggaaatcaaa

SEQ ID NO: 166 - DNA, 327 bp, Artificial Sequence
  Synthetic Polynucleotide
gagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcagtaccaccactctccactgacctttggcggaggcaccaaggtggaaatcaagaga

SEQ ID NO: 167 - DNA, 324 bp, Artificial Sequence
  Synthetic Polynucleotide
gagatcgtgctgacacagagccctggcacactgtcactgtctccaggcgaaagagccacactgagctgtagagccagccagagcgtgtccagcgattacctggcttggtatcagcagaagcccggacaggctcccagactgctgatctatggtgcctctcggagagccacaggcatccccgatagattttctggcagcggctccggcaccgacttcaccctgacaatcagcagactggaacccgaggacttcgccgtgtactactgccagcagtacgtgtcctactggacctttggcggaggcaccaaggtggaaatcaagaga

SEQ ID NO: 168 - DNA, 327 bp, Artificial Sequence
  Synthetic Polynucleotide
gacatccagatgacacagagccctagcagcctgtctgccagcgtgggagacagagtgaccatcacctgtagagccagccaggacgtgaacacagccgtggcttggtatcagcagaagcctggcaaggcccctaagctgctgatctacagcgccagctttctgtacagcggcgtgcccagcagattcagcggaagcagaagcggcaccgacttcaccctgacaatatccagcctccagcctgaggacttcgccacctactactgccagcagcactacaccacacctccaacattcggccagggcaccaaggtggaaatcaagagaaca

SEQ ID NO: 169 - DNA, 342 bp, Artificial Sequence
  Synthetic Polynucleotide
gacgtggtcatgacacagagccctctgagcctgcctgtgacacttggacagcctgccagcatcagctgcaagagcagtcagagcctgctggactccgacggcaagacctacctgaactggttccagcagaggcccggacagtctcctagacggctgatctacctggtgtccaaggtggacagcggcgtgcccgatagattttctggcagcggctctggcaccgacttcaccctgaagatcagcagagtggaagccgaggacgtgggcgtgtactactgtctgcaaggcacacacagcccactgaccttcggccagggaaccagactggaaatcaagagaaca

SEQ ID NO: 170 - DNA, 321 bp, Artificial Sequence
  Synthetic Polynucleotide
gatattcagatgacacagagccctagcagcctgagcgcctctgtgggagacagagtgaccatcacatgcaaggccagccagaacgtggacaccaacgtggcctggtatcagcagaagcctggacaggctcccaagagcctgatctacagcgccagctacagatacagcgacgtgcccagcagattttccggctctgccagcggcaccgatttcaccctgacaatcagcagcgtgcagagcgaggacttcgccacctactattgccagcagtacgacagctacccctacacctttggcggaggcaccaagctggaaatcaag

SEQ ID NO: 171 - DNA, 321 bp, Artificial Sequence
  Synthetic Polynucleotide
gatattcagatgacacagagccctagcagcctgagcgcctctgtgggagacagagtgaccatcacatgcaaggccagccagaacgtggacaccaacgtggcctggtatcagcagaagcctggacaggctcccaagagcctgatctacagcgccagctacagatacagcgacgtgcccagcagattttccggctctgccagcggcaccgatttcaccctgacaatcagcagcgtgcagagcgaggacttcgccacctactattgccagcagtacgacagctacccctacacctttggctgcggcaccaagctggaaatcaag

SEQ ID NO: 172 - DNA, 321 bp, Artificial Sequence
  Synthetic Polynucleotide
caaatcgtgctgacacagagccccgccatcatgagtgcttccccaggcgagaaagtgaccatcagctgtagcgcctctagcagcgtgtcctacatgtactggtatcagcagaagcccggcagcagccccaagccttggatctacagaacctacaacctggcctccggcgtgccagccagattttctggttctggaagcggcaccagctacagcctgaccatctctagcatggaagccgaggatgccgccacttactactgccagcagagccacacataccctccaacctttggcggcggaacaaagctggaaatcaagcgg

SEQ ID NO: 173 - DNA, 321 bp, Artificial Sequence
  Synthetic Polynucleotide
gatattcagatgacacagagccccagcagcgtgtccgcctctgtgggagatagagtgaccatcacctgtagagccagccagggcatcacaagatggctggcctggtatcagcagaagccaggcaaggcccctaagctgctgatctacgccgcttctgtgctccagagcggagtgcctagcagattttctggcagcggctccggcaccgatttcaccctgacaatatccagcctccagcctgaggacttcgccacctactactgccagcagagcaacagcttccccagaacattcggacagggcaccaaggtggaaatcaag

SEQ ID NO: 174 - DNA, 321 bp, Artificial Sequence
  Synthetic Polynucleotide
gatattcagatgacacagagccccagcagcgtgtccgcctctgtgggagatagagtgaccatcacctgtcgggccagccaggacattagcagatggctggcttggtatcagcagaagccaggcaaggcccctaagctgctgatttcagccgccagcagactccagagcggagtgcctagcagattttctggctctggcagcggcaccgacttcaccctgacaatatctagcctccagcctgaggacttcgccatctactattgccagcaggccaagagcttccccagaacatttggacagggcaccaaggtggaaatcaag

SEQ ID NO: 175 - DNA, 336 bp, Artificial Sequence
  Synthetic Polynucleotide
gataccgtgatgacccagacacctctgagcagccacgtgacacttggacagcctgccagcatcagctgtagaagcagccagagcctggtgcacagcgacggcaatacctacctgtcttggctccagcagaggccaggacagcctcctagactgctgatctaccggatcagcagacggttcagcggcgtgcccgatagattttctggaagcggagccggcaccgacttcaccctggaaatcagcagagtggaagccgaggatgtgggcgtctactactgtatgcagagcacccacgtgccacggacctttggacagggcaccaaggtggaaatcaag

SEQ ID NO: 176 - DNA, 321 bp, Artificial Sequence
  Synthetic Polynucleotide
gatattcagctgactcagagccccagcttcctgtctgcctctgtgggcgacagagtgaccatcacatgttgggccagccagggcatcaacaactacctggcctggtatcagcagaagcccggcaaggctcctaagctgctgatctacgccgccagcacactgcaaacaggcgtgccaagcagattttccggctctggcagcggcaccgagttcaccctgacaatatctagcctccagcctgaggacttcgccacctactactgccagcagctgaacagctaccctctgacctttggaggcggcaccaaggtggaaatcaag

SEQ ID NO: 177 - DNA, 339 bp, Artificial Sequence
  Synthetic Polynucleotide
gatgtggttatgacacagagccctctgagcctgcctgtggctcttggacagcctgccagcatcagctgtagaagcagccagagcctggtgtacacagacggcaacacctacctgaactggttccaccagcggccaggccagtctcctagacggctgatctacaaggtgtccaacagagacagcggcgtgcccgacagattcacaggatctggaagcggcaccgacttcaccctgaagatcagcagagtggaagccgaggatgtgggcgtgttctactgtatgcaaggcagccactggcctccatacacattcggacagggcaccaagctggaaatcaag

SEQ ID NO: 178 - DNA, 339 bp, Artificial Sequence
  Synthetic Polynucleotide
gatattgtgatgacccagacacctctgagcagccccgttacacttggacagcctgccagcatcagctgtagaagcagccagagcctggtgcacagcgacggcaatacctacctgagctggctccatcagaggccaggacagcctcctagactgctgatctacaagatcagcaacagattcagcggcgtgcccgacagattttctggaagcggagccggcaccgccttcacactgaagattagcagagtggaagccgaggatgtgggcgtctactactgtatgcaggccacacagctgcccagaacattcggacagggcaccaaggtggaaatcaagcgg

SEQ ID NO: 179 - DNA, 324 bp, Artificial Sequence
  Synthetic Polynucleotide
gaaattgtgctgacacagagccccggcacactgtcactttctccaggcgaaagagccacactgagctgtagagccagccagagcgtgaacaagaactacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtattattgccagcagtacgacagaagccctctgacctttggaggcggcaccaaggtggaaatcaag

SEQ ID NO: 180 - DNA, 336 bp, Artificial Sequence
  Synthetic Polynucleotide
gatgtggtcatgacacagacccctctgagcctgcctgtgacacttggacagcctgccagcatcagctgtagatccagccagagcctggtgtacagagatggcaacacctacctgagctggttccagcagaggcctggacagtctcctcggcggctgatctacaaggtgtccaactggcagagcggcgtgcccgatagattttctggcggtggcagcggcaccgacttcaccctgaagatcagcagagtggaagccgaggacgtgggcgtgtactactgtatgcagggcacacactggcctccaacattcggccagggaacaaaggtggaaatcaag

SEQ ID NO: 181 - DNA, 318 bp, Artificial Sequence
  Synthetic Polynucleotide
atcgtgatgacccagactcctaagttcctgctggtgtctgccggcgacagagtgaccatcacctgtaaagccagccagagcgtgaacaacgacgtgtcctggttccagcagaagcccggccaatctcctacactgctgatctactacgccagcaacagatacaccggcgtgcccgatagattcaccggctctggctacggcaccgacttcacctttaccatcagcaccgtgcaggccgaggacctggctgtgtacttctgccagcaagactacagcagcccttacacctttggaggcggcaccaagctggaaatcaag

SEQ ID NO: 182 - DNA, 318 bp, Artificial Sequence
  Synthetic Polynucleotide
gacattcagatgacacagagccctagcagcctgagcgcctctgtgggagacagagtgacaattacctgtcgggccagccagtctatcaacaactacctgaactggtatcagcagaagcccggcaaggcccctacactgctgatctatgccgccagctctctccagagcggagtgcctagcagattcagcggaagcagaagcggcaccgacttcaccctgacaatatccagcctccagcctgaggacttcgccgcctacttttgccagcagacctacagcaaccccacctttggccagggcaccaaggtggaagtgaag

SEQ ID NO: 183 - DNA, 324 bp, Artificial Sequence
  Synthetic Polynucleotide
agctacgagctgacacagcctccaagcgtgtccgtgtctcctggacagacagccagcatcacctgtagcggcgataagctgggcgataagtacgccagctggtatcagcagaagcccggccagtctcctgtgctggtcatctaccaggacaacagaaggcccagcggcatccccgagagattcagcggcagcaatagcggcaataccgccacactgaccatcagcggcacccaggctatggacgaggccgactactattgccaggcttgggacagcgacacctacgtgttcggcaccggcaccaaagtgacagtgcttggacaa

SEQ ID NO: 184 - DNA, 321 bp, Artificial Sequence
  Synthetic Polynucleotide
gatattcagatgacacagagccccagcagcctgtctgcctctgtgggagacagagtgaccatcacctgtagagccagccagagcatcagcagctacctgaactggtatcagcagaagcccggcaaggcccctaaactgctgatctatgccgcctccagtctgcagagcggagtgcctagcagattttctggctctggcagcggcaccgacttcaccctgacaatatctagcctgcagcctgaggacttcgccacctactactgccagcagagctacatcacccctctgacattcggtggcggcaccaaggtggaaatcaag

SEQ ID NO: 185 - DNA, 339 bp, Artificial Sequence
  Synthetic Polynucleotide
gacatcgtgctgacacagagccctgcttctctggccgtgtctcttggacagggcgctaccatcagctgtagagccagcaagagcgtgtccaccagcggctacacctacatgcactggtatcagcagaagcccggccagcctcctaagctgctgatctacctggcctccaacctggaaagcggagtgcctgccagattttctggcagcggctctggcaccgacttcaccctgaatatccatcctgtggaagaagaggacgccgccacctactactgtcagcactctggcgaactgccacctagctttggcggaggcaccaagctggaaatcaagagagct

SEQ ID NO: 186 - DNA, 321 bp, Artificial Sequence
  Synthetic Polynucleotide
gacgtgcagatcacacagagccctagctacctggctgcctctcctggcgagacaatcaccatcaactgtcgggccagcaagagcatcagcaagtacctggcctggtatcaagagaagcccggcaagaccaacaagctgctgatctacagcggcagcacactccagtctggcatccccagcagattttccggctctggcagcggcaccgatttcaccctgaccataagcagcctggaacctgaggacttcgccatgtactactgccagcagcaccacgaatacccctacacctttggcggaggcaccaagctggaaatcaaa

SEQ ID NO: 187 - DNA, 324 bp, Artificial Sequence
  Synthetic Polynucleotide
gacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaa

SEQ ID NO: 188 - DNA, 336 bp, Artificial Sequence
  Synthetic Polynucleotide
gacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaa

SEQ ID NO: 189 - DNA, 336 bp, Artificial Sequence
  Synthetic Polynucleotide
gatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaag

SEQ ID NO: 190 - DNA, 324 bp, Artificial Sequence
  Synthetic Polynucleotide
gaaatcgtgctgacacagagccccggcacactgtcactttctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtattactgccagcagtacggctacagccctcctacatttggcggaggcaccaagctggaaatcaag

SEQ ID NO: 191 - DNA, 336 bp, Artificial Sequence
  Synthetic Polynucleotide
gaaattgtgctgacacagttccccggcacactgtctcttagccctggcgaaagagccacactgagctgtagagccagccagtccgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtattattgccagcagtacggcagcagccctctgacatttggcggcggaacaaagctggaaatcaagacagtggctgcc

SEQ ID NO: 192 - DNA, 330 bp, Artificial Sequence
  Synthetic Polynucleotide
tcttatgagctgacccagcctccaagcgtgtccgtgtctcctggacagacagccagcatcacctgtagcggcgatagactgggcgagaagtacacctcctggtatcagcagaggcccggacagtctcctctgctggtcatctaccaggacaccaagaggccaagcggcatccccgagagattcagcggcagcaatagcggcaataccgccacactgaccatcagcggcacccaggctatggacgaggccgactactattgccaggcttgggagagcagcaccgtggtttttggcggaggcacaaagctgaccgtgctgacagtggctgcc

SEQ ID NO: 193 - DNA, 351 bp, Artificial Sequence
  Synthetic Polynucleotide
gacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgcc

SEQ ID NO: 194 - DNA, 351 bp, Artificial Sequence
  Synthetic Polynucleotide
gacgtggtcatgacacagacccctctgagcctgcctgtgacacctggcgaacctgccagcatcagctgtagaagcagccagagcatcgtgcacagcaacggcaacacctacctggaatggtatctccagaagcctggacagagccccaagctgctgatctacaagctgagcaacagattcagcggcgtgcccgacagattttctggcagcggctctggcaccgacttcaccctgaagattagcagagtggaagccgaggacgtgggcgtgtacttctgtagccaaggctctcacttcccctacaccttcggccagggcaccaagctggaaatcaagagaacagtggctgcc

SEQ ID NO: 195 - DNA, 336 bp, Artificial Sequence
  Synthetic Polynucleotide
gacatccagatgacacagagccctagcagcctgtctgccagcgtgggagacagagtgaccatcacctgtagagccagccagagcatcgacacccggctgaactggtatcagcagaagcctggcaaggcccctaagctgctgatctactctgccagctctctccagagcggcgtgccaagcagattttctggcagcggctctggcaccgacttcaccctgacaatatccagcctccagcctgaggacttcgccacctactactgtcagcagagcgcctacaatcccatcaccttcggccagggcaccaaggtggaaatcaagagaacagtggctgcc

SEQ ID NO: 196 - DNA, 336 bp, Artificial Sequence
  Synthetic Polynucleotide
gacattgtgatgacacagagccccagctctatgtacgccagcctgggagagagagtgaccattacctgcaaggccagccaggacatcaacagctacctgagctggttccagcagaagcccggcaagagccccaagacactgatctacagagtgaaccggctggtggatggcgtgcccagcagattttctggctctggcagcggccaggattacagcctgaccatcagcagcctggaatacgaggacgtgggcatctactactgcctccagtacgacgagttccctctgacactcggagccggcacaaagctggaactgaagagaacagtggccgcc

SEQ ID NO: 197 - DNA, 336 bp, Artificial Sequence
  Synthetic Polynucleotide
gatattgtgatgacccagagccagaaattcatgagcaccagcgtgggcgacagagtgtccgtgacatgtaaagccagccagaacgtgggctctcacgtcggctggtatcagcagaagtctggacagagccccaaggcactgatctacagcgccagcaatcggtacatcggcgtgcccgatagattcaccggctctggcagcggcaccgatttcaccctgaccatcagcaacgtgcagtccgaggacctggccgagtatttctgccagcagtaccacatctacccctacacctttggaggcggcacccggctggaaatcaagagaacagtggctgcc

SEQ ID NO: 198 - DNA, 351 bp, Artificial Sequence
  Synthetic Polynucleotide
gatgtggtcatgacacagacccctctgagcctgcctgtgacacctggcgaacctgccagcatcagctgtagaagcagccagagactggtgcacagcaacggcaacacctacctgcactggtatctccagaagccaggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccatgtgccttggacctttggacaggggaccaagctggaaatcaagagaacagtggctgcc

SEQ ID NO: 199 - DNA, 336 bp, Artificial Sequence
  Synthetic Polynucleotide
gatattcagctgacacagagcccctccagcctgtctgcctctgtgggagatagagtgaccatgacctgtagcgccagcagcagcgtgtccagcagctacctgtggtatcagcagaagcctggcaaggcccctaagctgtggatctacagcaccagcaatctggcctcaggcgtgccagccagattttctggctctggcagcggcaccgatttcaccctgacaatatccagcctccagccagaggacagcgccagctacttttgccaccagtggaacagatacccctacacctttggcggaggcacccggctggaaatcaagagaacagtggctgcc

SEQ ID NO: 200 - DNA, 336 bp, Artificial Sequence
  Synthetic Polynucleotide
gatattgtgatgacccagagccacaagatcatgagcaccagcgtgggcgacagagtgtccatcacatgcaaagccagccaggacgtgtccaacatcgtcgtgtggttccagcagaagcccggccagtctcctaacctgctgatctacagcgccagctacagatacaccggcgtgcccgatagattcacaggcagcggctctggcaccgacttcacctttacaatcagcagcgtgcaggccgaggacctggccgtgtattattgccagcagcactacagcagcccctacacctttggcggaggcaccaagctggaaatcaagagaacagtggccgcc

SEQ ID NO: 201 - DNA, 336 bp, Artificial Sequence
  Synthetic Polynucleotide
gacattcagatgactcagagccctagcagcctgagcgcctctgtgggagacagagtgaccatcacctgtagagccagccaggatgtgtctacagccgtggcctggtatcagcagaagcctggaaaggcccctaagctgctgatctacagcgccagcttcctgtacagcggcgtgccaagcagattttctggcagcggctctggcaccgacttcaccctgacaatatccagcctccagcctgaggacttcgccacctattactgccagcacagctacgccacacctttcacattcggacagggcaccaaggtggaaatcaagagaacagtggccgcc

SEQ ID NO: 202 - DNA, 336 bp, Artificial Sequence
  Synthetic Polynucleotide
gacatccagatgacacagagccctagcagcctgtctgccagcgtgggagacagagtgaccatcacatgcaaggccagccagaacgtgcggaccaccgtggattggtatcagcagaagcctggcaaggcccctaagctgctgatctacctggcctccaatagacacaccggcgtgcccagcagattttctggctctggcagcggcaccgacttcaccctgacaatatctagcctccagcctgaggacttcgccacctactactgcctccagcaccggaactaccctctgacatttggcggaggcaccaaggtggaaatcaagagaacagtggctgcc

SEQ ID NO: 203 - DNA, 336 bp, Artificial Sequence
  Synthetic Polynucleotide
gacatccagatgacacagagccctagcagcctgtctgccagcgtgggagacagagtgaccatcacatgtagcgccagccagggcatcagaaactacctgaactggtatcagcagaaacccggcaaggtgcccaagctgctgatctactacaccagcagactgcacagcggcgtgcccagcagattttctggctctggcagcggcaccgacttcaccctgacaatatctagcctccagcctgaggacgtggcaacctactactgtcagcagtacggcaagctgccctacacattcggccagggcaccaagctggaaatcaagagaacagtggctgcc

SEQ ID NO: 204 - DNA, 330 bp, Artificial Sequence
  Synthetic Polynucleotide
gacatccagatgacacagagccctagcagcctgtctgcctctctcggcggcaaagtgaccatcacctgtagagccagccaggacatcaacaagttcatcagctggtatcagcacaggcccggcaagggacctagactgctgatccactacgccagcacactccagcctggcatccctagcagattttccggctctggcagcggcagagactacagcttcagcatcagcaacctggaacctgaggacattgccacctactactgcctccagtacgacaacctgtggacctttggcggaggcaccaagctggaaatcagaacagttgctgct

SEQ ID NO: 205 - DNA, 348 bp, Artificial Sequence
  Synthetic Polynucleotide
gatcctgtgatgacacagacacccgccagcgtgtccgaacctgttggaggcacagtgaccatcaagtgccaggccagccagagcatctacagctacctggcctggtatcagcagaagcccggacagcctcctaagctgctgatctacaaggccagcagcctggaaagcggcgtgccaagtagactgtctggcagcggatctggcaccgagttcaccctgaccatcagcgatctggaatgtgccgacgccgccacttactactgtcaaggcggctatatcagcaccacagtgtccttcggctacggctttggcggaggaacagaggtggtggtcaagacagtggctgcc

SEQ ID NO: 206 - DNA, 354 bp, Artificial Sequence
  Synthetic Polynucleotide
gacattcagatgacacagagccctagcagcctgagcgcctctgtgggagacagagtgaccatcacatgcaagagcagccagacactgctgtactactccaaccagaagaactacctggcctggtatcagcagaaacccggcaaggtgcccaagctgctgatctactgggccagcacaagagatagcggcgtgcccagcagattttctggcagcggctctggcaccgacttcaccctgacaatatccagcctccagcctgaggacgtggcaacctactactgccagcagtattacaactaccctctgaccttcggccaggggaccaagctggaaatcaagagaacagtggccgcc

SEQ ID NO: 207 - DNA, 348 bp, Artificial Sequence
  Synthetic Polynucleotide
gacatcgtgatgacacagagccccgatagcctggccgtgtcactgggagaaagagccaccatcaactgtcgggccagcgagtccgtggacagctacggcaatagcttcatgcactggtatcagcagaagcccggccagcctcctaagctgctgatctacctggcctccaacctggaaagcggcgtgcccgatagattttctggcagcggctctggcaccgacttcaccctgacaattagcagcctccaggccgaggatgtggccgtgtattactgccagcagaacaacgaggaccctctgacattcggacagggcaccaaggtggaaatcaagagaacagtggccgcc

SEQ ID NO: 208 - DNA, 330 bp, Artificial Sequence
  Synthetic Polynucleotide
gagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgcc

SEQ ID NO: 209 - DNA, 330 bp, Artificial Sequence; identical to SEQ ID NO: 208
  Synthetic Polynucleotide

SEQ ID NO: 210 - DNA, 348 bp, Artificial Sequence
  Synthetic Polynucleotide
gacatcgtgatgacacagagccccgatagcctggccgtgtctctgggagaaagagccaccatcaactgtagagccggcgagagcgtggacatcttcggcgtgggatttctgcactggtatcagcagaagcccggccagcctcctaagctgctgatctacagagccagcaacctggaaagcggcgtgcccgatagattttctggcagcggctctggcaccgacttcaccctgacaatcagacctctccaggccgaggatgtggccgtgtattattgccagcagaccaacgaggacccctacacatttggacagggcaccaagctggaaatcaagagaacagtggccgcc

SEQ ID NO: 211 - DNA, 336 bp, Artificial Sequence
  Synthetic Polynucleotide
gacatcgtgctgacacagtctcccgccacactgtcactgtctccaggcgaaagagccacactgagctgtagagccagccagaacatcgtgttcaacctggcctggtatcagcagaagcctggacaggctccccggctgctgatctacgatgccagcaatagagccaccggcgtgcccgccagattttctggttctggcagcggcaccgacttcaccctgaccatatctagcctggaacctgaggacttcgccgtgtactactgccagcagaaaaagtccatgcctctgaccttcggccagggcaccaaggtggaaatcaagagaacagtggctgcc

SEQ ID NO: 212 - DNA, 339 bp, Artificial Sequence
  Synthetic Polynucleotide
cagacagtggtcacccaagagcctagcctgacagtgtctcctggcggaaccgtgacactgacatgtggcagttctaccggcgctgtgaccaccagcaattacgccaactgggtgcagcagaagccaggccaagctcctagaggactgatcggcggcacaaacaagagagcccctggcacaccagccagattttctggctctctgctcggcggaaaggccgctcttacactgtctggtgtccagcctgaggacgaggccgagtattattgcgccctgtggtacagcaacctgtgggttttcggcggaggcaccaagctgacagtgctgactgttgctgct

SEQ ID NO: 213 - DNA, 342 bp, Artificial Sequence
  Synthetic Polynucleotide
gaaattgtgctgacacagagccccggcacactgtcactttctccaggcgaaagagccacactgagctgtagagccagccagagcgtgtccagctcttacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtattattgccagcagtacaccaacgagcactactacaccttcggccagggcaccaaggtggaaatcaagagaacagtggccgcc

SEQ ID NO: 214 - DNA, 339 bp, Artificial Sequence
  Synthetic Polynucleotide
gagatcgtgctgacacagtctcccgccacactgtcactgtctccaggcgaaagagccacactgagctgtagcgtgtccagcagcatcagcagcagcaacctgcactggtatcagcagaagcctggacaggcccctcggctgctgatctacggcacatctaatctggcctctggcatccccgccagattttctggctctggaagcggcaccgacttcaccctgaccataagcagcctggaacctgaggacttcgccgtgtactactgccagcagtggtccagctatccccacacatttggcggaggcaccaaggtggaaatcaagagaacagtggctgcc

SEQ ID NO: 215 - DNA, 336 bp, Artificial Sequence
  Synthetic Polynucleotide
gacatccagatgacacagagccctagcagcctgtctgccagcgtgggagacagagtgaccatcacctgtaaagccggccagaacgtgggcacaagcgtggcatggtatcagcagaagcctggcaaggcccctaagctgctgatctacagcgccagctacagatacagcggcgtgcccagcagattttctggcagcggctctggcaccgacttcaccctgacaatatccagcctccagcctgaggacttcgccacctactactgccagcagtacatcacatacccctacaccttcggccagggcaccaaggtggaaatcaagagaacagtggctgcc

SEQ ID NO: 216 - DNA, 336 bp, Artificial Sequence
  Synthetic Polynucleotide
gacatcgtgctgacacagtctcccgccacactgtcactgtctccaggcgaaagagccacactgagctgtagagccagccagagcatcagcaacaacctgcactggtatcagcagaaccccggacaggctcccagactgctgatctactacggcagccagtccatcagcggcatccctgccagattttctggcagcggctctggcaccgatttcaccctgaccataagcagcctggaacctgaggacttcgccgtgtactactgccagcagagcaatagctggcccctgacatttggcggaggcaccaagctggaaatcaagagaacagtggctgcc

SEQ ID NO: 217 - DNA, 354 bp, Artificial Sequence
  Synthetic Polynucleotide
gacatcgtgatgacacagagccctgatagcctggccgtgtctctgggagagagagccaccatcaactgcaagagcagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctaccctctgaccttcggccagggcaccaaggtggaaatcaagagaacagtggctgcc

SEQ ID NO: 218 - DNA, 354 bp, Artificial Sequence
  Synthetic Polynucleotide
gacatcgtgatgacacagagccctgatagcctggccgtgtctctgggagagagagccaccatcaactgcaagagcagccagagcctgctgaacagcggcaaccagaagaactacctgacctggtatcagcagaagcccggccagcctcctaagctgctgatctactgggccagcaccagagatagcggcgtgcccgatagattttctggctctggcagcggcaccgacttcaccctgacaatttctagcctgcaagccgaggacgtggccgtgtactactgccagaacgactacagctaccctctgaccttcggccagggcaccaaggtggaaatcaagagaacagtggctgcc

SEQ ID NO: 219 - DNA, 351 bp, Artificial Sequence
  Synthetic Polynucleotide
gacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgcc

SEQ ID NO: 220 - DNA, 336 bp, Artificial Sequence
  Synthetic Polynucleotide
gacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgcc

SEQ ID NO: 221 - DNA, 336 bp, Artificial Sequence
  Synthetic Polynucleotide
gacatccagatgacccagtctccaagcagcctgtctgccagcgtgggcgacagagtgacaatcacatgtagcgccagccagggcatcagcaactacctgaattggtatcagcagaaacccggcaagaccgtgaagctgctgatctactacacctccaacctgcacagcggcgtgcccagcagattttctggctctggcagcggcaccgattacaccctgacaatatccagcctccagcctgaggacttcgccacatattactgccagcagtacagcgagctgccctggacatttggacagggcaccaaggtggaaatcaagagaacagtggccgcc

SEQ ID NO: 222 - DNA, 354 bp, Artificial Sequence
  Synthetic Polynucleotide
gacattcagatgacacagagccctagcagcctgagcgcctctgtgggagacagagtgaccatcacatgcaagagcagccagagcctgctgtacagaagcaaccagaagaactacctggcctggtatcagcagaagcccggcaaggctcctaagctgctgatctactgggccagcaccagagaaagcggcgtgccaagcagattttccggcagcggctctggaaccgacttcaccctgacaatatccagcctccagcctgaggacttcgccacctactactgccagcagtattacaactaccccagaaccttcggacagggcaccaaggtggaaatcaagagaacagtggccgcc

SEQ ID NO: 223 - DNA, 351 bp, Artificial Sequence
  Synthetic Polynucleotide
gacatcgtgatgacccagacacctctgagcctgagcgtgacacctggacagcctgccagcatcagctgcaagtctagccagagcctgctggactccgacggcaagacctacctgaactggtatctccagaagccaggccagcctcctcagctgctgatctacctggtgtccaagctggatagcggcgtgcccgatagattttctggctctggcagcggcaccgacttcaccctgaagattagcagagtggaagccgaggacgtgggcatctactactgtatgcagggcacccactttccacagaccttcggccagggcaccaaggtggaaatcaagagaacagtggctgcc

SEQ ID NO: 224 - DNA, 348 bp, Artificial Sequence
  Synthetic Polynucleotide
cagtctgtgctgacacagcctccatctgcctctggcacacctggacagagagtgtccatcagctgtagcggcagcagcagcaacatcggcagcaacaccgtgaactggtatcagcagctgcctggcacagcccctaaactgctgatctacagcaacaaccagcggcctagcggcgtgcccgatagattcagcgatagcaagagcggcacaagcgccagcctggctatttctggactccagtctgaggacgaggccgactactattgtgccgcctgggacgatagcctgaacggcccttatgtgttcggcaccggcaccagagtgacagtgctgggaacagttgcagct

SEQ ID NO: 225 - DNA, 336 bp, Artificial Sequence
  Synthetic Polynucleotide
gttatctggatgacacagagccccagcagcgtgtccgcttctgtgggagataccgtgaccatcacctgtagagccagccagggcatcagaagttggctggcctggtatcagcagaagcctggcaaggcccctaagctgctgatctacggcgcttcttctctgcactctggcgtgcccagcagattttctggcagcggctctggcacctacttcaccctgacaatatccagcctccagcctgaggactttgccacctactattgccagcaggccgacagctttcctccttggacatttggacagggcaccaaggtggaaatcaagaccgtggctgct

SEQ ID NO: 226 - DNA, 336 bp, Artificial Sequence
  Synthetic Polynucleotide
gacatccagatgacacagagccctagcagcctgtctgccagcgtgggagacagagtgaccatcacatgtagcgccagccaggacatcggcaactttctgaactggtatcagcagaagcccggcaaggcccctaagctgctgatctactacacctccagcctgtacagcggcgtgcccagcagattttctggcagcggctctggcaccgacttcaccctgacaatatccagcctccagccagaggacttcgccacctactactgccagcagtacagcaagctgcccctgacctttggacagggcaccaagctggaaatcaagagaacagtggctgcc

SEQ ID NO: 227 - DNA, 336 bp, Artificial Sequence
  Synthetic Polynucleotide
gacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgct

SEQ ID NO: 228 - skipped

SEQ ID NO: 229 - DNA, 357 bp, Artificial Sequence
  Synthetic Polynucleotide
caggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagc

SEQ ID NO: 230 - DNA, 363 bp, Artificial Sequence
  Synthetic Polynucleotide
caggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagc

SEQ ID NO: 231 - DNA, 363 bp, Artificial Sequence
  Synthetic Polynucleotide
gaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagc

SEQ ID NO: 232 - DNA, 357 bp, Artificial Sequence
  Synthetic Polynucleotide
caggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagc

SEQ ID NO: 233 - DNA, 357 bp, Artificial Sequence
  Synthetic Polynucleotide
caggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagc

SEQ ID NO: 234 - DNA, 363 bp, Artificial Sequence
  Synthetic Polynucleotide
caagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatct

SEQ ID NO: 235 - DNA, 360 bp, Artificial Sequence
  Synthetic Polynucleotide
caagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttct

SEQ ID NO: 236 - DNA, 360 bp, Artificial Sequence
  Synthetic Polynucleotide
caagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttcc

SEQ ID NO: 237 - DNA, 357 bp, Artificial Sequence
  Synthetic Polynucleotide
caggttcagctggtgcagtctggggccgaagtgaagaaacctggcagctccgtgaaggtgtcctgcaaggcttccggctacaccttcagcagctactggatcgagtgggtccgacaggctcctggacaaggactggaatggatgggcgagatgctgcctggcagcggcagcagcaactacaacgagaagttcaagggccgcgtgacaatcaccgccgatgagagcacaagcaccgcctacatggaactgagcagcctgagaagcgaggacaccgccgtgtactattgtgccagaggcgacggcaactactggtacttcgatgtgtggggccagggcaccctggtcacagtttcttct

SEQ ID NO: 238 - DNA, 351 bp, Artificial Sequence
  Synthetic Polynucleotide
cagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttct

SEQ ID NO: 239 - DNA, 363 bp, Artificial Sequence
  Synthetic Polynucleotide
caagttcagctggttcagagcggagccgaagtgaagaaacctggggcctctgtgaaggtgtcctgcaaggcttccggctacacctttaccaactacggcatctcctgggtccgacaggcaccaggacaaggactggaatggatgggatggctgagcgcctacagcggcaataccatctacgcccagaaactccagggcagagtgaccatgaccaccgacaccagcaccaccaccgcctacatggaactgagaagcctgagatccgacgacaccgccgtgtattattgcgccagagacagaatcgtcgtgcggcccgactacttcgattattggggccagggaaccctggtcaccgtgtcatct

SEQ ID NO: 240 - DNA, 351 bp, Artificial Sequence
  Synthetic Polynucleotide
gaagttcagctggttgaatcaggtggcggcctggttcaacctggcggatctctgagactgtcttgtgccgccagcggcttcactttcagcggcagatccatgaactgggtccgacaggcccctggcaaaggactggaatgggtgtcctacatcagcagcgacagccggaccatctactacgccgatagcgtgaagggcagattcaccatctccagagacaacgccaagaacagcctgtacctccagatgaactccctgagagccgaggacacagccgtgtattattgtgccagaggcggccacggctacttcgatctttggggcagaggcaccctggtcaccgtttcttct

SEQ ID NO: 241 - DNA, 363 bp, Artificial Sequence
  Synthetic Polynucleotide
caagttcagctggttgaatcaggcggaggcgttgtgcagcctggcagaagtctgagactgtcttgtgccgccagcggcttcaccttcagcagctatggaatgcactgggtccgacaggcccctggcaaaggacttgaatgggtggccggcatttggtgggacggcagcaatgagaagtacgccgacagcgtgaagggcagattcaccatctccagagacaacagcaagaacaccctgtacctccagatgaacagcctgagagccgaggacacagccgtgtattattgcgccaaagaggccccttactacgccaaggactacatggacgtgtggggcaagggcaccacagtgactgtctcttct

SEQ ID NO: 242 - DNA, 360 bp, Artificial Sequence
  Synthetic Polynucleotide
gaagtgcagctggttgaatcaggtggcggcctggttcaacctggcggatctctgagactgagctgtgccgccagcggcttcaacatcaaggacacctacatccactgggtccgacaggcccctggcaaaggacttgaatgggtcgccagaatctaccccaccaacggctacaccagatacgccgactctgtgaagggcagattcaccatcagcgccgacaccagcaagaacaccgcctacctccagatgaactccctgagagccgaggacaccgccgtgtactactgtagcagatggggcggctggggcttctacgctatggattattggggccagggaaccctggtcaccgtgtcatct

SEQ ID NO: 243 - DNA, 336 bp, Artificial Sequence
  Synthetic Polynucleotide
caagttcagctggttcagtctggggccgaagtgaagaaacctggggcctctgtgaaggtgtcctgcaaggcttccggctacacctttaccaactactggatgaactgggtccgacaggctccaggccaaggactggaatggatgggcagaatcgaccccagcgacagcgagacacactacaaccagaacttcaaggaccgcgtgaccatgaccagagacaccagcacctccaccgtgtacatggaactgagcagcctgagaagcgaggacaccgccgtgtactattgtgccagctctggctattggggccagggcacaacagtgaccgttagctct

SEQ ID NO: 244 - DNA, 363 bp, Artificial Sequence
  Synthetic Polynucleotide
caggtgcagctggttgaatctggcggcggacttgtgaagcctggcgagtctctgagactgagctgtgccgccagcggcttcaccttcagcgactactacatgtactgggtccgacaggcccctggcaaaggactggaatgggtcgccatcatctccgacggcggctactacacctactacagcgacatcatcaagggcagattcaccatcagccgggacaacgccaagaacagcctgtacctccagaccaacagcctgaaggccgaggataccgccgtgtactattgcgccagaggcttcccactgctgagacacggcgcttttgatctgtggggccagggcacactggtcacagtttctagc

SEQ ID NO: 245 - DNA, 363 bp, Artificial Sequence
  Synthetic Polynucleotide
caggtgcagctggttgaatctggcggcggacttgtgaagcctggcgagtctctgagactgagctgtgccgccagcggcttcaccttcagcgactactacatgtactgggtccgacaggcccctggcaagtgtctggaatgggtcgccatcatctccgacggcggctactacacctactacagcgacatcatcaagggcagattcaccatcagccgggacaacgccaagaacagcctgtacctccagatgaactccctgaaggccgaggacaccgccgtgtactattgcgccagaggcttcccactgctgagacacggcgctatggattattggggccagggcacactggtcaccgtttctagc

SEQ ID NO: 246 - DNA, 360 bp, Artificial Sequence
  Synthetic Polynucleotide
gaagtgaagctggtggaatctgaaggcggcctggtgcagcctggcagctctatgaagctgagctgtaccgccagcggcttcaccttcagcgactactatatggcctgggtccgacaggtgcccgagaaaggacttgagtgggtcgccaacatcaactacgacggcaccaccacctactacctggacagcctgaagtcccggttcatcatcagccgggacaacagcaagaacatcctgtacctccagatgagcagcctgaaaagcgaggacaccgccacctattactgcgccagagtgctggatggctactacggctacttcgactattggggccagggcaccacactgtctgtttctagc

SEQ ID NO: 247 - DNA, 351 bp, Artificial Sequence
  Synthetic Polynucleotide
caggtgcagctggttgaatctggcggcggacttgtgaagcctggcggatctctgagactgagctgtgccgccagcggcttcaccttcagcgactactacatgacctggatcagacaggcccctggcaaaggactggaatggatcagctacatcagcagcagcggcagcaccatctactacgccgatagcgtgaagggcagattcaccatcagccgggacaacgccaagaacagcctgtacctccagatgaactccctgagagccgaggacaccgccgtgtactactgcgccagagacagaaacagccacttcgactattggggccagggcaccctggtcacagtttctagc

SEQ ID NO: 248 - DNA, 351 bp, Artificial Sequence
  Synthetic Polynucleotide
caggtgcagctggttgaatctggcggcggacttgtgaagcctggcggatctctgagactgagctgtgccgccagcggcttcaccttcagcgatcactacatgagctggatcagacaggcccctggcaaaggactggaatggttcagctacatcagcagcagcggcggcatcatctactacgccgatagcgtgaagggcagattcaccatcagccgggacaacgccaagaacagcctgtacctccagatgaactccctgagagccgaggacaccgccgtgtactactgtgccagagatgtgggcagccacttcgactattggggccagggaacactggtcaccgtttctagc

SEQ ID NO: 249 - DNA, 372 bp, Artificial Sequence
  Synthetic Polynucleotide
caggtgcagctggttgaatctggtggcggagtggtgcagtctggcagaagcctgagactgtcttgtgccgccagcggcttcaccttcagaaactacggaatgcactgggtccgacaggcccctggcaaaggacttgaatgggtcgccgtgatttggtacgacggcagcgacaagtactacgccgattctgtgcggggcagattcaccatcagccgggacaacagcaagaacaccctgtacctccagatgaacagcctgagagccgaggacaccgccgtgtactactgtgccagagatggctacgacatcctgaccggcaatcccagagacttcgactattggggccagggcacactggtcacagtttctagc

SEQ ID NO: 250 - DNA, 366 bp, Artificial Sequence
  Synthetic Polynucleotide
gaggtgcagctggttgaatctggcggaggactggttcagcctggcggatctctgagactgtcttgtgccgccagcggcttcccattcagcagctacgatatgcactgggtccgacaggccacaggcaaaggactggaatgggtgtccgccatcggaacagccggcgctacctattatcccggctctgtgaagggcagattcaccatcagcagagagaacgccaagaacagcctgtacctccagatgaactccctgagagccggcgataccgccgtgtactattgtgccagaggcgactacgtgtggggcacctacagacccctgttcgattattggggccagggcaccctggtcacagtttctagt

SEQ ID NO: 251 - DNA, 354 bp, Artificial Sequence
  Synthetic Polynucleotide
caggtgcagctggttgaatctggtggcggagttgtgcagcctggcagaagcctgagactgtcttgtgccgccagcggctttacctttagcgcctatgccatgcactgggtccgacaggcacctggcaaaggactggaatgggtcgccgtgatttggtacgacggcagcaacaagaactacgccgacagcgtgaagggcagattcaccgtgtccagagacaacagcaagaacaccctgtacctggaaatgaacagcctgagagccgaggacaccgccgtgtactattgtgccagggacctgatggtcggagtgaccaattattggggccagggcaccctggtcacagtgtctaca

SEQ ID NO: 252 - DNA, 363 bp, Artificial Sequence
  Synthetic Polynucleotide
caggtgcagctggttgaatctggcggcggaagcctgagactgtcttgtgctgcatctggcgtggtgcagcctggcagattcaccttcagcagctacggaatgcactgggtccgacaggcccctggcaaaggacttgaatgggtcgccgtgatttggtacgacggcagcaacaagtattacgtggacagcgtgaaaggccggttcaccatctccagagacaacagcaagaacaccctgtacctccagatgaacagcctgagagccgaggacaccgccgtgtactactgtgccagagatggatggcagcagctggccccttttgactattggggccagggcacactggtcaccgttagttctgct

SEQ ID NO: 253 - DNA, 354 bp, Artificial Sequence
  Synthetic Polynucleotide
caggttcagctgcaagagtctggccctggcctggtcaagcctagcgaaacactgagcctgacctgtaccgtgtctggggccagcatcagcagcttctactggtcctggatcagacagcctcctggcaaaggactggaatggatcggctacatctactacagcggcaccaccaactacaaccccagcctgaagtccagagtgaccatcagcgtggacaccagcaagaaccagttctccctgaagctgagcagcgtgacagccgccgatacagccgtgtactactgtgccagaattgccgtggccggcttcttcttcgactattggggccagggcaccctggtcacagtttctagc

SEQ ID NO: 254 - DNA, 369 bp, Artificial Sequence
  Synthetic Polynucleotide
caggttcagctggttcagtctggggccgaagtgaagaaacctggggcctctgtgaaggtgtcctgcaaggccagcggctacacctttaccaactactacatgcactgggtccgacaggcccctggactgggacttgagtggatgggcatcatcaaccctagcgacggcagcacaagctacgcccagaaattccagggcagagtgaccatgaccagagacaccagcaccaacaccgtgtacatggacctgagcagcctgagaagcgaggacaccgccgtgtactattgtgccagaggcggcaacagcgccttctacagctactacgacatggacgtgtggggccagggcaccacagtgacagtttctagc

SEQ ID NO: 255 - DNA, 348 bp, Artificial Sequence
  Synthetic Polynucleotide
caggttcagctccagcagtctggacctgagctggttaagcctggcgcttctgtgcggatctcttgcaaggccagcggctacaccttcaccacctactacatccactgggtcaagcagcggcctggacagggactcgaatggatcggctggatctaccccggcaacgtgaacaccaactacaacgagaagttcaagggcaaagccacactgaccgccgacaagagcagcagcacagcctacatgcagctgaccagcctgacctctgaggacagcgccgtgtacttttgtgccagaggcgtgtactacttcgactactggggccagggcaccatcctgacagtttctagc

SEQ ID NO: 256 - DNA, 357 bp, Artificial Sequence
  Synthetic Polynucleotide
caggttcagctgcaagagtctggccctggcctggtcaagcctagccaaacactgagcctgacctgtaccgtgtctggcggcagcatcaacaacaacaattactactggacctggatcagacagcaccccggcaaaggactggaatggatcggctacatctactacagcggcagcaccttctacaaccccagcctgaagtccagagtgaccatcagcgtggacaccagcaagacccagttctccctgaagctgagcagcgtgacagccgccgatacagccgtgtactactgcgccagagaagataccatgaccggcctggatgtgtggggccagggaacaacagtgacagtgtctagc

SEQ ID NO: 257 - DNA, 366 bp, Artificial Sequence
  Synthetic Polynucleotide
gaagttcagctggttcagagcggagccgaagtgaagaaacctggggcctctgtgaaggtgtcctgcaaggcttccggcgataccttcaagcggtactacgtgcactgggtccgacaggctccaggacaaggactggaatggatgggcatcatcaaccccagcggcgtgtccacaacatacgcccagaaattccagggcagagtgaccatgaccagagacaccagcacctccaccgtgtacatggaactgagcagcctgagaagcgaggacaccgccgtgtactactgtgctgaagtgcgcggcagcggcttcaactacttcggcatggatgtgtggggccagggcacactggttaccgtttcttct

SEQ ID NO: 258 - DNA, 366 bp, Artificial Sequence
  Synthetic Polynucleotide
gaggttcagctgcttgagtctggcggaggactggttcaacctggcggaagcctgagactgtcttgtgccgccagcggcttcacctttagcagctacgccatgagctgggtccgacaggctcctggcaaaggactggaagtggtggtgtctgccatttctggcggcggaggcagaacctactacgccgattctgtgaagggcagattcaccatcagccgggacaacagcaagaacaccctgtacctgcagatgaacagcctgagagccgaggacaccgccgtgtactactgtgccagagaagagatggccttccgggcctacagattcgacatctggggccagggaaccctggtcacagtttctagc

SEQ ID NO: 259 - DNA, 372 bp, Artificial Sequence
  Synthetic Polynucleotide
gaagtgcagctggtggaatctggcggcgaccttgtgaaacctggcggctctctgaagctgagctgtgccgtgtccggcttcacctttagcagctacggcatgagctgggtccgacagacccctgacaagagactggaatgggtcgccacagtgtctagcggcggcacctacacatattaccccgacagcgtgaagggcagattcaccatcagccgggacaacgccaagaacaccctgtacctccagatgagcagcctgaagtccgaggacagcgccatgtactactgcgccagacaccggggcaattactacgccacctattattacgctatggactactggggccagggcaccagcgtgacagtttcttct

SEQ ID NO: 260 - DNA, 363 bp, Artificial Sequence
  Synthetic Polynucleotide
caggttcagctgcaacagcctggcgctgaactcgttagacctggcgcttctgtgaagctgagctgcaaggccagcggctacaccttcaccacctactggatgaactgggtcaagcagcggcctgagcagggcctcgaatggatcggcagaatcgacccctacgacagcgagacacactacaaccagaagttcaaggacaaggccatcctgaccgtggacaagagcagctccacagcctacatgcagctgagcagcctgaccagcgaggatagcgccgtgtactattgcgccagaggaccctactacggaacaaacccctggtttccctattggggccagggcacactggtcaccgttagctct

SEQ ID NO: 261 - DNA, 369 bp, Artificial Sequence
  Synthetic Polynucleotide
gaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttct

SEQ ID NO: 262 - DNA, 366 bp, Artificial Sequence
  Synthetic Polynucleotide
caagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttct

SEQ ID NO: 263 - DNA, 357 bp, Artificial Sequence
  Synthetic Polynucleotide
caggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagc

SEQ ID NO: 264 - DNA, 360 bp, Artificial Sequence
  Synthetic Polynucleotide
gaggttcagctgcttgagtctggcggaggactggttcaacctggcggaagcctgagactgtcttgtgccgccagcggcttcacctttagcagctacgccatgagctgggtccgacaggctcctggcaaaggactggaatgggtgtccgtgatctctggctctggcggcagacccaattacgccgattctgtgaagggcagattcaccatcagccgggacaacagcaagaacaccctgtacctccagatgaacagcctgcgcgacgaggataccgccgtgtactattgtgccaaggtggactacagcaactacctgttcttcgactactggggccagggcaccctggtcacagtttctagc

SEQ ID NO: 265 - DNA, 366 bp, Artificial Sequence
  Synthetic Polynucleotide
caggttcagctgcaagagtctggccctggcctggtcaagcctagccaaacactgagcctgacctgtaccgtgtctggcggctctattagcagaggcggctactactggtcctggatcagacagcaccctggcaaaggactggaatggatcggctacatcttctaccggggcagaacctactacaaccccagcctgaagtccagagtgaccatcagcgtggacaccagcaagaaccagttctccctgaagctgagcagcgtgacagccgccgatacagccgtgtactactgcgccagagtgaacagcaactacggatggttcgacccttggggccagggcacactggttacagtttctagtgcttcc

SEQ ID NO: 266 - DNA, 381 bp, Artificial Sequence
  Synthetic Polynucleotide
caggtgcagctggttgaatctggtggcggagttgttcagcctggcggctctctgagactgtcttgtgccgccagcggcttcaccttcagcagctatggaatgcactgggtccgacaggcccctggcaaaggacttgagtgggtcgccttcatttggtacgacggcagcaacaagtattacgccgacagcgtgaagggcagattcaccatctccagagacaacagcaagaacaccctgtacctccagatgaacagcctgagagccgaggacaccgccgtgtactattgtgctcggagagccggcatcatcggcaccatcggctactactacggcatggatgtgtggggccagggcaccacagtgacagtttctagtgcttcc

SEQ ID NO: 267 - DNA, 369 bp, Artificial Sequence
  Synthetic Polynucleotide
caagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttcc

SEQ ID NO: 268 - DNA, 363 bp, Artificial Sequence
  Synthetic Polynucleotide
gaagttcagctggttcagtctggggccgaagtgaagaagccaggcgagagcctgaaaatcagctgccaggctttcggctacacctttagcacccactggatcgagtggatcagacagatgccaggccagggcctcgaatggatcggagagattctgcctggaagcggcagcaccagctacaacgagaagttcaaaggccaggccacactgagcgccgacaagtctagcagcacagcctacctccagtggtcctctctgaaggccagcgacaccgccatgtacttttgcgccagatggctgctgtactactacgctatggactactggggccagggaacaatggtcaccgtgtctagtgcttcc

SEQ ID NO: 269 - DNA, 366 bp, Artificial Sequence
  Synthetic Polynucleotide
caagttcagctggttcagtctggggccgaagtgaagaaacctggcagcagcgtgaaggtgtcctgcaaagcaagcggcggcacctttagcagctacgccatctcttgggtccgacaggctcctggacaaggactggaatggatgggcggcatcatccccatcttcggcacagccaattacgcccagaaattccagggccgcgtgacaatcacagccgacgagtctacaagcaccgcctacatggaactgagcagcctgagaagcgaggacaccgccgtgtactactgtgccagaagctcctacggctggtcctacgagttcgactattggggccagggaaccctggtcacagtgtctagtgcttcc

SEQ ID NO: 270 - DNA, 345 bp, Artificial Sequence
  Synthetic Polynucleotide
gaagtgcagcttcagcagtctgccgccgaacttgctagacctggcgcttctgtgcggatgagctgtagaaccagcggctacaccttcaccacctacaccatccactggatgaagcagcggcctggacagggccttgagtggatcggctacatcaaccccaacggcggctataccgagtacaaccagaagttccgggacagaaccacactgaccgccgacaagtctagcagcaccgcctacatgcagctgagcagcctgacaagcgaggacagcgccgtgtactactgcaccagaaacttcgactactggggccagggcacaaccctgacagtgtctagtgcttct

SEQ ID NO: 271 - DNA, 348 bp, Artificial Sequence
  Synthetic Polynucleotide
gaggttcagctgcttgagacaggcggaggactggttcaacctggcggaagcagaggactgagctgtgaaggcagcggctttaccttcagcggcttctggatgagctgggtccgacagacacctggcaagaccctggaatggatcggcgacatcaatagcgacggcagcagcatcaactacgcccctagcatcaaggacaggttcaccatcttccgggacaacgacaagagcatcctgtacctccagatgaccaacgtgcggagcgaggacaccggcacctacttttgtgtgaccacctacggcgactactggggccagggaacaaccctgacagtgtctagtgcttct

SEQ ID NO: 272 - DNA, 360 bp, Artificial Sequence
  Synthetic Polynucleotide
gaagtgcagctggttcagtctggggccgaagtgaagaagcctggcgagagcctgaagatcagctgccaggctttcggctataccttcaccagcttttggatgcactggatcagacagatgcccggccagggcctcgaatggatcggagtgatcgatcccagcgacacctacaccaactacaaccagaagttcaaaggccaggccacactgagcgccgacaagtctagcagcacagcctacctccagtggtcctctctgaaggccagcgataccgccatgtacttttgcgccagaggcgactacagcaactggttcacatattggggccagggcacaatggtcaccgtgtcatctgcatct

SEQ ID NO: 273 - DNA, 363 bp, Artificial Sequence
  Synthetic Polynucleotide
caggttcagctgcaacagtctggggccgaagtgaagaaacctggggcctctgtgaaggtgtcctgtgaagccagcggctacacattccccagctacgtgctgcactgggtcaaacaggctccaggccaaggactggaatggatcggctacatcaacccctacaacgacggcacccagtacaacgagaagttcaagggcaaagccacactgaccagagacaccagcatcaacaccgcctacatggaactgagccggctgagatccgatgacaccgccgtgtactattgcgccagaggctttggcggcagctacggctttgcttattggggccagggcaccctggtcacagtgtcatctgcatct

SEQ ID NO: 274 - DNA, 366 bp, Artificial Sequence
  Synthetic Polynucleotide
caggtgcagctgaagcagtctggacctggactggtgcagcctagccagagcctgagcatcacctgtaccgtgtccggcttcagcctgaccagatttggcgtgcactgggtccgacagagccctggcaaaggactggaatggctgggagtgatttggagaggcggcagcaccgattacaacgccgccttcatgagccggctgaccatcaccaaggacaacagcaagagccaggtgttcttcaagctgaacagcctgaaggtggacgacaccgccatctactactgctccaaccactactacggcagcagcgactacgccctggataattggggccagggcatcagcgtgacagtgtctagtgcttct

SEQ ID NO: 275 - DNA, 366 bp, Artificial Sequence
  Synthetic Polynucleotide
gaggtgcagctggttgaatctggcggaggactggttcagcctggcggatctctgagactgtcttgtgccgccagcggcttcaccatcaccaactatggcatccactgggtccgacaggcccctggcaaaggacttgagtgggtcggaagaatctaccccgatagcggagccacctactacgccgattctgtgaagggcagattcaccatctccgccgacaccagcaagaacaccgcctacctccagatgaacagcctgagagccgaggacaccgccgtgtactactgtgccagaaagctgtggatctctatcgccggcatggactattggggccagggcacactggtcacagtgtcatctgcatct

SEQ ID NO: 276 - DNA, 366 bp, Artificial Sequence
  Synthetic Polynucleotide
gaagtgcagctggttgaatctggcggcggactggttaagcctggcggatctctgagactgagctgtgccgccagcggcttcaccttcagcagctacgatatgagctgggtccgacaggcccctggcaaaggacttgaatgggtgtccacaatcagcagcggcggcaactacaactactaccccgacagcgtgaagggcagattcaccatctccagagacaacgccaagaacagcctgtacctccagatgaactccctgagagccgaggacaccgccgtgtactattgcgccagacactacgactaccctgactacgctatggactactggggccagggcaccaccgtgacagttagctctgcttct

SEQ ID NO: 277 - DNA, 357 bp, Artificial Sequence
  Synthetic Polynucleotide
gaagttcagctggttgaatcaggcggcggactggttcaacctggcggatctctgagactgagctgtgccgccagcggcttcacattttccgacgcctggatggactgggtccgacaggctcctggaaaaggactggaatgggtcggagagatccggtccaaagtgaacaaccacgaaacctactatgccgagagcgtgaagggcagattcaccatcagccgggacgacagcaagaacagcctgtacctccagatgaactccctgaaaaccgaggacaccgccgtgtactactgcgccagaaacgactacttcgactactggggccagggaaccaccgtgacagtgtctagtgcttcc

SEQ ID NO: 278 - DNA, 357 bp, Artificial Sequence
  Synthetic Polynucleotide
gaagttcagctccagcagagcggccctgagcttgtgaaacctggcgcttctgtgcggatgagctgtaaagccagcggctacaccttcaccgactacaacatgtactgggtcaagcagagcctgggcaagagcctggaatggatcggctacatctaccccaataccggcggagccacctacaaccagaagttcaagggcaaagccacactgaccgtgaacaagagcagcagcaccgccttcatggaactgagaagcctgaccagcgaggacagcgccgtgtactattgtggaagaggcggcctgggacctttcgcctattggggacagggaaccctggtcacagtgtctgctgcttct

SEQ ID NO: 279 - DNA, 342 bp, Artificial Sequence
  Synthetic Polynucleotide
cagagcctggaagaatctggcggcggacttgtgaagcctggcggaacactgaccctgatctgtaccgtgtctggcatcgacctgagcacctacggcgtgatctgggttcgacaggcccctagagaaggactggaatggatcggcttcatcaccagaagcggcaccacagattatgccgcctgggccaatggccggttcaccatcagcaagaccagcaccaccgtggacctgaagatcgcctctctgacagccgccgataccgccacctacttttgtgccagaggcggctacagattcaacctgtggggccacggaaccctggtcacagtttctagtgcttcc

SEQ ID NO: 280 - DNA, 366 bp, Artificial Sequence
  Synthetic Polynucleotide
gaggtgcagctggttgaatctggcggaggactggttcagcctggcggatctctgagactgtcttgtgccgccagcggcttcaccttcagcgacttcgatatggaatgggtccgacaggcccctggcaaaggactcgaatgggttggagccagccggaacaaggccaacgactacaccacacagtacagcgccagcgtgaagggcagattcaccatcagcagagacaccagcaagaacagcctgtacctccagatgaactccctgaaaaccgaggacaccgccgtgtactactgcgccagagacagatacgactacgccctggattattggggccagggcaccaccgtgacagtgtcaagtgcttct

SEQ ID NO: 281 - DNA, 360 bp, Artificial Sequence
  Synthetic Polynucleotide
caggttcagctggttcagtctggggccgaagtgaagaaacctggggcctctgtgaaggtgtcctgcaaggccagcggcttcaacatcaaggacacctacatccactgggtccgacaggcccctggacaaggacttgagtggatgggcagaatcgaccccgccaacggcaaggccaactacgaccctaagttccagggcagagtgaccatgaccagagacaccagcacctccaccgtgtacatggaactgagcagcctgagaagcgaggacaccgccgtgtactattgtgctctcggcggaggctactacggcatggattattggggccagggcaccctggtcacagtgtcatctgcatct

SEQ ID NO: 282 - DNA, 348 bp, Artificial Sequence
  Synthetic Polynucleotide
gaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatct

SEQ ID NO: 283 - DNA, 366 bp, Artificial Sequence
  Synthetic Polynucleotide
gaggtgcagctggtcgagagcggaggcggcctggtgcagcctggcggcagcctgagactgagctgcgccgccagcggctacagcttcaccggctacaccatgaactgggtccggcaggcacctggcaagggactggaatgggtggccctgatcaacccctacaagggcgtgagcacctacaaccagaagttcaaggaccggttcaccatcagcgtggacaagagcaagaacaccgcctatctgcagatgaacagcctgcgggccgaggacaccgccgtgtactactgcgccagaagcggctactacggcgacagcgactggtacttcgacgtgtggggccagggcaccctcgtgaccgtgtctagc

SEQ ID NO: 284 - DNA, 369 bp, Artificial Sequence
  Synthetic Polynucleotide
gaggttcagctgcaagagtctggggccgaagtgaagaaacctggcagcagcgtgaaggtgtcctgcaaggccagcggcttcaacatcaaggacacctacatgcactgggtccgacaggcccctggacaaggacttgagtggatgggcagaatcgaccccgccaacggcaacagcaaatacgtgcccaagttccagggcagagtgaccatcacagccgacgagagcacaagcaccgcctacatggaactgagcagcctgagaagcgaggacaccgccgtgtactactgtgcccctttcggctactacgtgtccgactacgccatggcctattggggccagggaaccaccgtgacagtgtctagtgcatct

SEQ ID NO: 285 - DNA, 360 bp, Artificial Sequence
  Synthetic Polynucleotide
caagttcagctggttcagtctggggccgaagtgaagaaacctggcagcagcgtgaaggtgtcctgcaaagcaagcggcggcacctttagcagctacgccatctcttgggtccgacaggcaccaggacaaggactggaatggatgggcctgattatccccagatacggcaaggccagatacgcccagaaattccagggcagagtgaccatcaccgccgacgagtctacaagcaccgcctacatggaactgagcagcctgagaagcgaggacacagccgtgtattattgcgcccggaactggccctactactacatggatttttggggccagggaaccctggtcaccgtgtctagtgcatct

SEQ ID NO: 286 - DNA, 366 bp, Artificial Sequence
  Synthetic Polynucleotide
gaggtgcagctggttgaatctggcggcggacttgtgaagcctggcggatctctgagactgagctgtgccgccagcggcttcacctttagcaatgcctggatgagctgggtccgacaggcccctggaaaaggactggaatgggtcggacggatcaagagcaagaccgaaggcggcaccaccgattatgctgcccctgtgaagggcagattcaccatcagcagggacgacagcaagaacaccctgtacctccagatgaacagcctgaaaaccgaggacaccgccgtgtactactgcaccacaccttacgagtggtcttggtacgactactggggccagggcacactggtcacagtgtcatctgcatct

SEQ ID NO: 287 - DNA, 363 bp, Artificial Sequence
  Synthetic Polynucleotide
caggttcagctggttcagtctggggccgaagtgaagaaacctggggcctctgtgaaggtgtcctgcaaggcttccggctacacctttaccagctactacatgcactgggtccgacaggcccctggacaaggacttgagtggatgggcatcatcaaccctagcggcggcagcacaagctacgcccagaaattccagggcagagtgaccatgacacacgacaccagcacctccaccgtgtacatggaactgagcagcctgagaagcgaggacaccgccgtgtactactgcgccagatccttcttcaccggcttccacctggattactggggccagggaacactggtcacagtgtcatctgcatct

SEQ ID NO: 288 - DNA, 384 bp, Artificial Sequence
  Synthetic Polynucleotide
caggttcagctggttcagagcggagccgaagtgaagaaacctggggcctctgtgaaggtgtcctgcaaggcttccggctacacctttaccaactacctgatcgagtgggtccgacaggctccaggacaaggactggaatggatgggcctgattaaccctggcagcggcggcaccaactacaacgagaagttcaagggcagagtgaccatgaccaccgacaccagcacaagcaccgcctacatggaactgcggagcctgagaagcgacgacaccgccgtgtattattgcgccagaagaagccctctcggctcttggatctactacgcctatgacggcgtggcctattggggccagggaacactggttacagtgtcctctgccagc

SEQ ID NO: 289 - DNA, 342 bp, Artificial Sequence
  Synthetic Polynucleotide
gaagttcagctggttgaatcaggcggcggactggttcaacctggcggatctctgagactgagctgtgccgccagcggcttcaccttcagcagatactggatgagctgggtccgacaggcccctggcaaaggacttgaatgggtcgccgagatcaaccccgacagcagcaccatccagtacaccccatctctgaaggcccggttcaccctgtccgtggacagaagcaagaacaccctgtacctccagatgaactccctgagagccgaggacaccgccgtgtactattgtgccagacctgcctattggggccagggaacactggtcacagtgtctagcgcttcc

SEQ ID NO: 290 - DNA, 357 bp, Artificial Sequence
  Synthetic Polynucleotide
gaagttcagctgcaagagtccggcgctgaagtgaagaaacctggggcctctgtgaaggtgtcctgcaaggccagcggctacagctttaccggctacaccatgaactgggtccgacaggcacctggacagggccttgaatggatgggcctgattaacccctacaacggcggcaccacctacaaccagaaattcaagggcaaagtgaccatgaccagggacaccagcatcagctccgcctacatggaactgagccggctgagatccgatgacaccgccgtgtattattgcgccagagactgggactactacttcgacgtgtggggccagggcacaaccgtgacagtttcttctgccagc

SEQ ID NO: 291 - DNA, 360 bp, Artificial Sequence
  Synthetic Polynucleotide
caagttcagctggttcagtctggggccgaagtgaagaaacctggcagcagcgtgaaggtgtcctgcaaggccagcggctacagcttcaccagcaactggatgcactgggtccgacaggctccaggacaaggactggaatggatgggcgtgatcgaccccagcgacacctacatcagctacaaccagaaattcaagggccgcgtgaccatcaccgccgatgagtctacaagcaccgcctacatggaactgagcagcctgagaagcgaggacaccgccgtgtattattgcgccagaagagacagcggctggtacttcgatgtgtggggccagggaacactggtcacagtgtctagcgcttcc

SEQ ID NO: 292 - DNA, 369 bp, Artificial Sequence
  Synthetic Polynucleotide
caagttcagctggttcagtctggggccgaagtgaagaaacctggcagcagcgtgaaggtgtcctgcaaggcttccggctacacctttaccagctactggatgcactgggtccgacaggctccaggacaaggactggaatggatgggcaacatcgaccccagcgacagcgaaatctactacaaccagaaattcaaggaccgcgtgaccatcaccgccgacgagtctacaagcaccgcctacatggaactgagcagcctgagaagcgaggacaccgccgtgtattattgcgccagaagaagcggcagccgggactactacggcatggatgattggggccagggaaccctggtcacagtgtctagtgcttcc

SEQ ID NO: 293 - DNA, 351 bp, Artificial Sequence
  Synthetic Polynucleotide
gaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagc

SEQ ID NO: 294 - DNA, 378 bp, Artificial Sequence
  Synthetic Polynucleotide
caggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttcc

SEQ ID NO: 295 - DNA, 366 bp, Artificial Sequence
  Synthetic Polynucleotide
gaggtgcagctggtggaatctggacctgctctggtcaagcccacacagaccctgacactgacctgtaccgtgtccggctttagcctgaccggctacagcgtgaactggatcagacagcctcctggcaaggccctggaatggctgggaatgatctggggagatggcagcaccgactacaacagcgccctgaagtccagactgaccatcagcaaggacaccagcaagaaccaggtggtgctgaccatgaccaacatggaccctgtggacaccgccacctactactgcgccagagactactacttcaactacgccagttggttcgcctactggggccagggaacactggtcacagtgtcatctgcatct

SEQ ID NO: 296 - DNA, 378 bp, Artificial Sequence
  Synthetic Polynucleotide
gaggtgcagctggttgaatctggcggaggactggttcagcctggcggatctctgagactgagctgtgccgtgtctggctacagcatcaccagcgactacgcctggaactgggttcgacaggcccctggcaaaggactggaatgggtcggatatatcagcaacagcggcagcaccagctacaaccccagcctgaagtcccggttcaccatcagcagagacaccagcaagaacaccctgtacctccagatgaacagcctgagagccgaggacaccgccgtgtactattgcgccagagagcggaactacgactacgacgattactactacgctatggactactggggccagggcaccctggttacagtgtcaagtgcttct

SEQ ID NO: 297 - DNA, 345 bp, Artificial Sequence
  Synthetic Polynucleotide
caagttcagctggttcagtctggggccgaagtgaagaaacctggggcctctgtgaaggtgtcctgcaaggcttccggctacacctttaccacctactacatgaactgggtccgacaggctccaggccagggacttgaatggatgggcatgatcgaccccagcgacagcgagacacactacaaccagaaattccagggcagagtgaccatgaccgccgacaccagcacaagcaccgcctacatggatctgcggagcctgagatccgatgacaccgccgtgtactactgcgccagaagtctggccttttggggccagggaaccaccgtgacagtgtctagtgcttcc

SEQ ID NO: 298 - DNA, 372 bp, Artificial Sequence
  Synthetic Polynucleotide
gaagtgcagctggttgaatcaggtggcggcctggttcaacctggcggatctctgagactgtcttgcgccgcctctggcttcaccctgaacagcagagatatgcactgggtccgacaggcccctggcaaaggacttgaatgggtgtccgccatcagcattgccggcgacacctactatcctctgtctgtgcggggcagattcaccatcagcagagacaacgccaagaacagcctgtacctccagatgaactccctgagagccgaggacaccgccgtgtactactgtgctaggggcagacacttcgacggctacaagagcgtgttcttcgactcttggggccagggcacaaccgtgacagtgtctagtgcttcc

SEQ ID NO: 299 - DNA, 369 bp, Artificial Sequence
  Synthetic Polynucleotide
gaagtgcagctggttcagtctggggccgaagtgaagagaagcggagcctctgtgaaggtgtcctgcaagctgagcggcgacacactgaccgatctgagcatccactgggtccgacaggcccctggaaaaggactggaatggatgggcggcttcgacttcgaggatggcgagatcgtgtacggcgacaagttcaagggcagagtgaccgtgacagaggaccccagcacagacaccgcctacatggacctgaagcggctgacctttgaggacaccgccatctactactgcgccaccatcaaggacatccctggccggtactacttcgatttctggggccagggcaccctggtcacagtgtcatctgcatct

SEQ ID NO: 300 - DNA, 363 bp, Artificial Sequence
  Synthetic Polynucleotide
caagttcagctggttcagtctggggccgaagtgaagaaacctggggcctctgtgaaggtgtcctgcaaggcttccggctacacctttaccggctacaacatccactgggtccgacaggctcccggccaaagacttgaatggatgggcgctatctaccccggcaacggcgataccagctacaagcagaaattccggggcagagtgacaattaccagagacaccagcgccagcaccgcctacatggaactgtctagcctgagaagcgaggacaccgccgtgtactattgcgccagaggcgaaacagccagagccacctttgcctattggggccagggaaccctggtcacagtgtctagtgcttcc

SEQ ID NO: 301 - DNA, 369 bp, Artificial Sequence
  Synthetic Polynucleotide
caggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttct

SEQ ID NO: 302 - skipped

SEQ ID NO: 303 - DNA, 738 bp, Artificial Sequence
  Synthetic Polynucleotide
caggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcggcggaggcggaagtggaggcggaggatctggcggcggaggctctgatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaag

SEQ ID NO: 304 - DNA, 729 bp, Artificial Sequence
  Synthetic Polynucleotide
caggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcggcggaggcggaagtggaggcggaggatctggcggcggaggctctgatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaag

SEQ ID NO: 305 - DNA, 729 bp, Artificial Sequence
  Synthetic Polynucleotide
gaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcggcggaggcggaagtggaggcggaggatctggcggcggaggctctgatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaag

SEQ ID NO: 306 - DNA, 723 bp, Artificial Sequence
  Synthetic Polynucleotide
caggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcggcggaggcggaagtggaggcggaggatctggcggcggaggctctgatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcgg

SEQ ID NO: 307 - DNA, 723 bp, Artificial Sequence
  Synthetic Polynucleotide
caggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcggcggaggcggaagtggaggcggaggatctggcggcggaggctctcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagaga

SEQ ID NO: 308 - DNA, 732 bp, Artificial Sequence
  Synthetic Polynucleotide
gacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagaggcggaggcggaagtggaggcggaggatctggcggcggaggctctcaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatct

SEQ ID NO: 309 - DNA, 723 bp, Artificial Sequence
  Synthetic Polynucleotide
gagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaaggcggaggcggaagtggaggcggaggatctggcggcggaggctctcaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttct

SEQ ID NO: 310 - DNA, 738 bp, Artificial Sequence
  Synthetic Polynucleotide
gacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccggcggaggcggaagtggaggcggaggatctggcggcggaggctctcaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttcc

SEQ ID NO: 311 - DNA, 720 bp, Artificial Sequence
  Synthetic Polynucleotide
gacatccagatgacacagagccctagcagcctgtctgccagcgtgggagacagagtgaccatcacctgtagagccagcagcagcgtgggctacatgcactggtatcagcagaagcctggcaaggcccctaagctgctgatctacgccaccagcaatctggcctctggcgtgccaagcagattttccggctctggctacggcaccgacttcaccctgacaatatccagcctccagcctgaggacttcgccacctactactgccagcagtggtccagcgatcctcctacatttggcggaggcaccaaggtggaaatcaaaggcggaggcggaagtggaggcggaggatctggcggcggaggctctcaggttcagctggtgcagtctggggccgaagtgaagaaacctggcagctccgtgaaggtgtcctgcaaggcttccggctacaccttcagcagctactggatcgagtgggtccgacaggctcctggacaaggactggaatggatgggcgagatgctgcctggcagcggcagcagcaactacaacgagaagttcaagggccgcgtgacaatcaccgccgatgagagcacaagcaccgcctacatggaactgagcagcctgagaagcgaggacaccgccgtgtactattgtgccagaggcgacggcaactactggtacttcgatgtgtggggccagggcaccctggtcacagtttcttct

SEQ ID NO: 312 - DNA, 738 bp, Artificial Sequence
  Synthetic Polynucleotide
gacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagggcagcacaagcggcagcggaaagcctggatctggcgagggatctaccaagggacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttct

SEQ ID NO: 313 - DNA, 729 bp, Artificial Sequence
  Synthetic Polynucleotide
gagatcgtgctgacacagtctcccgccacactgtcactgtctccaggcgaaagagccacactgagctgtagagccagccagagcgtgtcctcttacctggcctggtatcagcagaagcctggacaggctccccggctgctgatctacgatgccagcaatagagccacaggcatccccgccagattttctggctctggcagcggcaccgatttcaccctgaccataagcagcctggaacctgaggacttcgccgtgtactactgccagcagagaagcaactggcccagaacattcggccagggcaccaaggtggaaatcaaaggcggaggcggaagtggaggcggaggatctggcggcggaggctctcaagttcagctggttcagagcggagccgaagtgaagaaacctggggcctctgtgaaggtgtcctgcaaggcttccggctacacctttaccaactacggcatctcctgggtccgacaggcaccaggacaaggactggaatggatgggatggctgagcgcctacagcggcaataccatctacgcccagaaactccagggcagagtgaccatgaccaccgacaccagcaccaccaccgcctacatggaactgagaagcctgagatccgacgacaccgccgtgtattattgcgccagagacagaatcgtcgtgcggcccgactacttcgattattggggccagggaaccctggtcaccgtgtcatct

SEQ ID NO: 314 - DNA, 723 bp, Artificial Sequence
  Synthetic Polynucleotide
gagatcgtgctgacacagagccctggcacactgtcactgtctccaggcgaaagagccacactgagctgtagagccagccagagcgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtactactgccagcagtaccaccactctccactgacctttggcggaggcaccaaggtggaaatcaagagaggcggaggcggaagtggaggcggaggatctggcggcggaggctctgaagttcagctggttgaatcaggtggcggcctggttcaacctggcggatctctgagactgtcttgtgccgccagcggcttcactttcagcggcagatccatgaactgggtccgacaggcccctggcaaaggactggaatgggtgtcctacatcagcagcgacagccggaccatctactacgccgatagcgtgaagggcagattcaccatctccagagacaacgccaagaacagcctgtacctccagatgaactccctgagagccgaggacacagccgtgtattattgtgccagaggcggccacggctacttcgatctttggggcagaggcaccctggtcaccgtttcttct

SEQ ID NO: 315 - DNA, 732 bp, Artificial Sequence
  Synthetic Polynucleotide
gagatcgtgctgacacagagccctggcacactgtcactgtctccaggcgaaagagccacactgagctgtagagccagccagagcgtgtccagcgattacctggcttggtatcagcagaagcccggacaggctcccagactgctgatctatggtgcctctcggagagccacaggcatccccgatagattttctggcagcggctccggcaccgacttcaccctgacaatcagcagactggaacccgaggacttcgccgtgtactactgccagcagtacgtgtcctactggacctttggcggaggcaccaaggtggaaatcaagagaggcggaggcggaagtggaggcggaggatctggcggcggaggctctcaagttcagctggttgaatcaggcggaggcgttgtgcagcctggcagaagtctgagactgtcttgtgccgccagcggcttcaccttcagcagctatggaatgcactgggtccgacaggcccctggcaaaggacttgaatgggtggccggcatttggtgggacggcagcaatgagaagtacgccgacagcgtgaagggcagattcaccatctccagagacaacagcaagaacaccctgtacctccagatgaacagcctgagagccgaggacacagccgtgtattattgcgccaaagaggccccttactacgccaaggactacatggacgtgtggggcaagggcaccacagtgactgtctcttct

SEQ ID NO: 316 - DNA, 732 bp, Artificial Sequence
  Synthetic Polynucleotide
gacatccagatgacacagagccctagcagcctgtctgccagcgtgggagacagagtgaccatcacctgtagagccagccaggacgtgaacacagccgtggcttggtatcagcagaagcctggcaaggcccctaagctgctgatctacagcgccagctttctgtacagcggcgtgcccagcagattcagcggaagcagaagcggcaccgacttcaccctgacaatatccagcctccagcctgaggacttcgccacctactactgccagcagcactacaccacacctccaacattcggccagggcaccaaggtggaaatcaagagaacaggcggaggcggaagtggaggcggaggatctggcggcggaggctctgaagtgcagctggttgaatcaggtggcggcctggttcaacctggcggatctctgagactgagctgtgccgccagcggcttcaacatcaaggacacctacatccactgggtccgacaggcccctggcaaaggacttgaatgggtcgccagaatctaccccaccaacggctacaccagatacgccgactctgtgaagggcagattcaccatcagcgccgacaccagcaagaacaccgcctacctccagatgaactccctgagagccgaggacaccgccgtgtactactgtagcagatggggcggctggggcttctacgctatggattattggggccagggaaccctggtcaccgtgtcatct

SEQ ID NO: 317 - DNA, 723 bp, Artificial Sequence
  Synthetic Polynucleotide
gacgtggtcatgacacagagccctctgagcctgcctgtgacacttggacagcctgccagcatcagctgcaagagcagtcagagcctgctggactccgacggcaagacctacctgaactggttccagcagaggcccggacagtctcctagacggctgatctacctggtgtccaaggtggacagcggcgtgcccgatagattttctggcagcggctctggcaccgacttcaccctgaagatcagcagagtggaagccgaggacgtgggcgtgtactactgtctgcaaggcacacacagcccactgaccttcggccagggaaccagactggaaatcaagagaacaggcggaggcggaagtggaggcggaggatctggcggcggaggctctcaagttcagctggttcagtctggggccgaagtgaagaaacctggggcctctgtgaaggtgtcctgcaaggcttccggctacacctttaccaactactggatgaactgggtccgacaggctccaggccaaggactggaatggatgggcagaatcgaccccagcgacagcgagacacactacaaccagaacttcaaggaccgcgtgaccatgaccagagacaccagcacctccaccgtgtacatggaactgagcagcctgagaagcgaggacaccgccgtgtactattgtgccagctctggctattggggccagggcacaacagtgaccgttagctct

SEQ ID NO: 318 - DNA, 729 bp, Artificial Sequence
  Synthetic Polynucleotide
caggtgcagctggttgaatctggcggcggacttgtgaagcctggcgagtctctgagactgagctgtgccgccagcggcttcaccttcagcgactactacatgtactgggtccgacaggcccctggcaaaggactggaatgggtcgccatcatctccgacggcggctactacacctactacagcgacatcatcaagggcagattcaccatcagccgggacaacgccaagaacagcctgtacctccagaccaacagcctgaaggccgaggataccgccgtgtactattgcgccagaggcttcccactgctgagacacggcgcttttgatctgtggggccagggcacactggtcacagtttctagcggcggaggcggaagtggaggcggaggatctggcggcggaggctctgatattcagatgacacagagccctagcagcctgagcgcctctgtgggagacagagtgaccatcacatgcaaggccagccagaacgtggacaccaacgtggcctggtatcagcagaagcctggacaggctcccaagagcctgatctacagcgccagctacagatacagcgacgtgcccagcagattttccggctctgccagcggcaccgatttcaccctgacaatcagcagcgtgcagagcgaggacttcgccacctactattgccagcagtacgacagctacccctacacctttggcggaggcaccaagctggaaatcaag

SEQ ID NO: 319 - DNA, 729 bp, Artificial Sequence
  Synthetic Polynucleotide
caggtgcagctggttgaatctggcggcggacttgtgaagcctggcgagtctctgagactgagctgtgccgccagcggcttcaccttcagcgactactacatgtactgggtccgacaggcccctggcaagtgtctggaatgggtcgccatcatctccgacggcggctactacacctactacagcgacatcatcaagggcagattcaccatcagccgggacaacgccaagaacagcctgtacctccagatgaactccctgaaggccgaggacaccgccgtgtactattgcgccagaggcttcccactgctgagacacggcgctatggattattggggccagggcacactggtcaccgtttctagcggcggaggcggaagtggaggcggaggatctggcggcggaggctctgatattcagatgacacagagccctagcagcctgagcgcctctgtgggagacagagtgaccatcacatgcaaggccagccagaacgtggacaccaacgtggcctggtatcagcagaagcctggacaggctcccaagagcctgatctacagcgccagctacagatacagcgacgtgcccagcagattttccggctctgccagcggcaccgatttcaccctgacaatcagcagcgtgcagagcgaggacttcgccacctactattgccagcagtacgacagctacccctacacctttggctgcggcaccaagctggaaatcaag

SEQ ID NO: 320 - DNA, 771 bp, Artificial Sequence
  Synthetic Polynucleotide
gaagtgaagctggtggaatctgaaggcggcctggtgcagcctggcagctctatgaagctgagctgtaccgccagcggcttcaccttcagcgactactatatggcctgggtccgacaggtgcccgagaaaggacttgagtgggtcgccaacatcaactacgacggcaccaccacctactacctggacagcctgaagtcccggttcatcatcagccgggacaacagcaagaacatcctgtacctccagatgagcagcctgaaaagcgaggacaccgccacctattactgcgccagagtgctggatggctactacggctacttcgactattggggccagggcaccacactgtctgtttctagcggaggcggaggatctggtggcggaggaagtggcggaggcggtagtggtggcggcggttcaggcggtggtggttctggcggtggcggatctcaaatcgtgctgacacagagccccgccatcatgagtgcttccccaggcgagaaagtgaccatcagctgtagcgcctctagcagcgtgtcctacatgtactggtatcagcagaagcccggcagcagccccaagccttggatctacagaacctacaacctggcctccggcgtgccagccagattttctggttctggaagcggcaccagctacagcctgaccatctctagcatggaagccgaggatgccgccacttactactgccagcagagccacacataccctccaacctttggcggcggaacaaagctggaaatcaagcgg

SEQ ID NO: 321 - DNA, 717 bp, Artificial Sequence
  Synthetic Polynucleotide
caggtgcagctggttgaatctggcggcggacttgtgaagcctggcggatctctgagactgagctgtgccgccagcggcttcaccttcagcgactactacatgacctggatcagacaggcccctggcaaaggactggaatggatcagctacatcagcagcagcggcagcaccatctactacgccgatagcgtgaagggcagattcaccatcagccgggacaacgccaagaacagcctgtacctccagatgaactccctgagagccgaggacaccgccgtgtactactgcgccagagacagaaacagccacttcgactattggggccagggcaccctggtcacagtttctagcggcggaggcggaagtggaggcggaggatctggcggcggaggctctgatattcagatgacacagagccccagcagcgtgtccgcctctgtgggagatagagtgaccatcacctgtagagccagccagggcatcacaagatggctggcctggtatcagcagaagccaggcaaggcccctaagctgctgatctacgccgcttctgtgctccagagcggagtgcctagcagattttctggcagcggctccggcaccgatttcaccctgacaatatccagcctccagcctgaggacttcgccacctactactgccagcagagcaacagcttccccagaacattcggacagggcaccaaggtggaaatcaag

SEQ ID NO: 322 - DNA, 717 bp, Artificial Sequence
  Synthetic Polynucleotide
caggtgcagctggttgaatctggcggcggacttgtgaagcctggcggatctctgagactgagctgtgccgccagcggcttcaccttcagcgatcactacatgagctggatcagacaggcccctggcaaaggactggaatggttcagctacatcagcagcagcggcggcatcatctactacgccgatagcgtgaagggcagattcaccatcagccgggacaacgccaagaacagcctgtacctccagatgaactccctgagagccgaggacaccgccgtgtactactgtgccagagatgtgggcagccacttcgactattggggccagggaacactggtcaccgtttctagcggcggaggcggaagtggaggcggaggatctggcggcggaggctctgatattcagatgacacagagccccagcagcgtgtccgcctctgtgggagatagagtgaccatcacctgtcgggccagccaggacattagcagatggctggcttggtatcagcagaagccaggcaaggcccctaagctgctgatttcagccgccagcagactccagagcggagtgcctagcagattttctggctctggcagcggcaccgacttcaccctgacaatatctagcctccagcctgaggacttcgccatctactattgccagcaggccaagagcttccccagaacatttggacagggcaccaaggtggaaatcaag

SEQ ID NO: 323 - DNA, 753 bp, Artificial Sequence
  Synthetic Polynucleotide
caggtgcagctggttgaatctggtggcggagtggtgcagtctggcagaagcctgagactgtcttgtgccgccagcggcttcaccttcagaaactacggaatgcactgggtccgacaggcccctggcaaaggacttgaatgggtcgccgtgatttggtacgacggcagcgacaagtactacgccgattctgtgcggggcagattcaccatcagccgggacaacagcaagaacaccctgtacctccagatgaacagcctgagagccgaggacaccgccgtgtactactgtgccagagatggctacgacatcctgaccggcaatcccagagacttcgactattggggccagggcacactggtcacagtttctagcggcggaggcggaagtggaggcggaggatctggcggcggaggctctgataccgtgatgacccagacacctctgagcagccacgtgacacttggacagcctgccagcatcagctgtagaagcagccagagcctggtgcacagcgacggcaatacctacctgtcttggctccagcagaggccaggacagcctcctagactgctgatctaccggatcagcagacggttcagcggcgtgcccgatagattttctggaagcggagccggcaccgacttcaccctggaaatcagcagagtggaagccgaggatgtgggcgtctactactgtatgcagagcacccacgtgccacggacctttggacagggcaccaaggtggaaatcaag

SEQ ID NO: 324 - DNA, 732 bp, Artificial Sequence
  Synthetic Polynucleotide
gaggtgcagctggttgaatctggcggaggactggttcagcctggcggatctctgagactgtcttgtgccgccagcggcttcccattcagcagctacgatatgcactgggtccgacaggccacaggcaaaggactggaatgggtgtccgccatcggaacagccggcgctacctattatcccggctctgtgaagggcagattcaccatcagcagagagaacgccaagaacagcctgtacctccagatgaactccctgagagccggcgataccgccgtgtactattgtgccagaggcgactacgtgtggggcacctacagacccctgttcgattattggggccagggcaccctggtcacagtttctagtggcggaggcggaagtggaggcggaggatctggcggcggaggctctgatattcagctgactcagagccccagcttcctgtctgcctctgtgggcgacagagtgaccatcacatgttgggccagccagggcatcaacaactacctggcctggtatcagcagaagcccggcaaggctcctaagctgctgatctacgccgccagcacactgcaaacaggcgtgccaagcagattttccggctctggcagcggcaccgagttcaccctgacaatatctagcctccagcctgaggacttcgccacctactactgccagcagctgaacagctaccctctgacctttggaggcggcaccaaggtggaaatcaag

SEQ ID NO: 325 - DNA, 738 bp, Artificial Sequence
  Synthetic Polynucleotide
caggtgcagctggttgaatctggtggcggagttgtgcagcctggcagaagcctgagactgtcttgtgccgccagcggctttacctttagcgcctatgccatgcactgggtccgacaggcacctggcaaaggactggaatgggtcgccgtgatttggtacgacggcagcaacaagaactacgccgacagcgtgaagggcagattcaccgtgtccagagacaacagcaagaacaccctgtacctggaaatgaacagcctgagagccgaggacaccgccgtgtactattgtgccagggacctgatggtcggagtgaccaattattggggccagggcaccctggtcacagtgtctacaggcggaggcggaagtggaggcggaggatctggcggcggaggctctgatgtggttatgacacagagccctctgagcctgcctgtggctcttggacagcctgccagcatcagctgtagaagcagccagagcctggtgtacacagacggcaacacctacctgaactggttccaccagcggccaggccagtctcctagacggctgatctacaaggtgtccaacagagacagcggcgtgcccgacagattcacaggatctggaagcggcaccgacttcaccctgaagatcagcagagtggaagccgaggatgtgggcgtgttctactgtatgcaaggcagccactggcctccatacacattcggacagggcaccaagctggaaatcaag

SEQ ID NO: 326 - DNA, 747 bp, Artificial Sequence
  Synthetic Polynucleotide
caggtgcagctggttgaatctggcggcggaagcctgagactgtcttgtgctgcatctggcgtggtgcagcctggcagattcaccttcagcagctacggaatgcactgggtccgacaggcccctggcaaaggacttgaatgggtcgccgtgatttggtacgacggcagcaacaagtattacgtggacagcgtgaaaggccggttcaccatctccagagacaacagcaagaacaccctgtacctccagatgaacagcctgagagccgaggacaccgccgtgtactactgtgccagagatggatggcagcagctggccccttttgactattggggccagggcacactggtcaccgttagttctgctggcggaggcggaagtggaggcggaggatctggcggcggaggctctgatattgtgatgacccagacacctctgagcagccccgttacacttggacagcctgccagcatcagctgtagaagcagccagagcctggtgcacagcgacggcaatacctacctgagctggctccatcagaggccaggacagcctcctagactgctgatctacaagatcagcaacagattcagcggcgtgcccgacagattttctggaagcggagccggcaccgccttcacactgaagattagcagagtggaagccgaggatgtgggcgtctactactgtatgcaggccacacagctgcccagaacattcggacagggcaccaaggtggaaatcaagcgg

SEQ ID NO: 327 - DNA, 723 bp, Artificial Sequence
  Synthetic Polynucleotide
caggttcagctgcaagagtctggccctggcctggtcaagcctagcgaaacactgagcctgacctgtaccgtgtctggggccagcatcagcagcttctactggtcctggatcagacagcctcctggcaaaggactggaatggatcggctacatctactacagcggcaccaccaactacaaccccagcctgaagtccagagtgaccatcagcgtggacaccagcaagaaccagttctccctgaagctgagcagcgtgacagccgccgatacagccgtgtactactgtgccagaattgccgtggccggcttcttcttcgactattggggccagggcaccctggtcacagtttctagcggcggaggcggaagtggaggcggaggatctggcggcggaggctctgaaattgtgctgacacagagccccggcacactgtcactttctccaggcgaaagagccacactgagctgtagagccagccagagcgtgaacaagaactacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtattattgccagcagtacgacagaagccctctgacctttggaggcggcaccaaggtggaaatcaag

SEQ ID NO: 328 - DNA, 750 bp, Artificial Sequence
  Synthetic Polynucleotide
caggttcagctggttcagtctggggccgaagtgaagaaacctggggcctctgtgaaggtgtcctgcaaggccagcggctacacctttaccaactactacatgcactgggtccgacaggcccctggactgggacttgagtggatgggcatcatcaaccctagcgacggcagcacaagctacgcccagaaattccagggcagagtgaccatgaccagagacaccagcaccaacaccgtgtacatggacctgagcagcctgagaagcgaggacaccgccgtgtactattgtgccagaggcggcaacagcgccttctacagctactacgacatggacgtgtggggccagggcaccacagtgacagtttctagcggcggaggcggaagtggaggcggaggatctggcggcggaggctctgatgtggtcatgacacagacccctctgagcctgcctgtgacacttggacagcctgccagcatcagctgtagatccagccagagcctggtgtacagagatggcaacacctacctgagctggttccagcagaggcctggacagtctcctcggcggctgatctacaaggtgtccaactggcagagcggcgtgcccgatagattttctggcggtggcagcggcaccgacttcaccctgaagatcagcagagtggaagccgaggacgtgggcgtgtactactgtatgcagggcacacactggcctccaacattcggccagggaacaaaggtggaaatcaag

SEQ ID NO: 329 - DNA, 711 bp, Artificial Sequence
  Synthetic Polynucleotide
caggttcagctccagcagtctggacctgagctggttaagcctggcgcttctgtgcggatctcttgcaaggccagcggctacaccttcaccacctactacatccactgggtcaagcagcggcctggacagggactcgaatggatcggctggatctaccccggcaacgtgaacaccaactacaacgagaagttcaagggcaaagccacactgaccgccgacaagagcagcagcacagcctacatgcagctgaccagcctgacctctgaggacagcgccgtgtacttttgtgccagaggcgtgtactacttcgactactggggccagggcaccatcctgacagtttctagcggcggaggcggaagtggaggcggaggatctggcggcggaggctctatcgtgatgacccagactcctaagttcctgctggtgtctgccggcgacagagtgaccatcacctgtaaagccagccagagcgtgaacaacgacgtgtcctggttccagcagaagcccggccaatctcctacactgctgatctactacgccagcaacagatacaccggcgtgcccgatagattcaccggctctggctacggcaccgacttcacctttaccatcagcaccgtgcaggccgaggacctggctgtgtacttctgccagcaagactacagcagcccttacacctttggaggcggcaccaagctggaaatcaag

SEQ ID NO: 330 - DNA, 720 bp, Artificial Sequence
  Synthetic Polynucleotide
caggttcagctgcaagagtctggccctggcctggtcaagcctagccaaacactgagcctgacctgtaccgtgtctggcggcagcatcaacaacaacaattactactggacctggatcagacagcaccccggcaaaggactggaatggatcggctacatctactacagcggcagcaccttctacaaccccagcctgaagtccagagtgaccatcagcgtggacaccagcaagacccagttctccctgaagctgagcagcgtgacagccgccgatacagccgtgtactactgcgccagagaagataccatgaccggcctggatgtgtggggccagggaacaacagtgacagtgtctagcggcggaggcggaagtggaggcggaggatctggcggcggaggctctgacattcagatgacacagagccctagcagcctgagcgcctctgtgggagacagagtgacaattacctgtcgggccagccagtctatcaacaactacctgaactggtatcagcagaagcccggcaaggcccctacactgctgatctatgccgccagctctctccagagcggagtgcctagcagattcagcggaagcagaagcggcaccgacttcaccctgacaatatccagcctccagcctgaggacttcgccgcctacttttgccagcagacctacagcaaccccacctttggccagggcaccaaggtggaagtgaag

SEQ ID NO: 331 - DNA, 735 bp, Artificial Sequence
  Synthetic Polynucleotide
agctacgagctgacacagcctccaagcgtgtccgtgtctcctggacagacagccagcatcacctgtagcggcgataagctgggcgataagtacgccagctggtatcagcagaagcccggccagtctcctgtgctggtcatctaccaggacaacagaaggcccagcggcatccccgagagattcagcggcagcaatagcggcaataccgccacactgaccatcagcggcacccaggctatggacgaggccgactactattgccaggcttgggacagcgacacctacgtgttcggcaccggcaccaaagtgacagtgcttggacaaggcggaggcggaagtggaggcggaggatctggcggcggaggctctgaagttcagctggttcagagcggagccgaagtgaagaaacctggggcctctgtgaaggtgtcctgcaaggcttccggcgataccttcaagcggtactacgtgcactgggtccgacaggctccaggacaaggactggaatggatgggcatcatcaaccccagcggcgtgtccacaacatacgcccagaaattccagggcagagtgaccatgaccagagacaccagcacctccaccgtgtacatggaactgagcagcctgagaagcgaggacaccgccgtgtactactgtgctgaagtgcgcggcagcggcttcaactacttcggcatggatgtgtggggccagggcacactggttaccgtttcttct

SEQ ID NO: 332 - DNA, 732 bp, Artificial Sequence
  Synthetic Polynucleotide
gaggttcagctgcttgagtctggcggaggactggttcaacctggcggaagcctgagactgtcttgtgccgccagcggcttcacctttagcagctacgccatgagctgggtccgacaggctcctggcaaaggactggaagtggtggtgtctgccatttctggcggcggaggcagaacctactacgccgattctgtgaagggcagattcaccatcagccgggacaacagcaagaacaccctgtacctgcagatgaacagcctgagagccgaggacaccgccgtgtactactgtgccagagaagagatggccttccgggcctacagattcgacatctggggccagggaaccctggtcacagtttctagcggcggaggcggaagtggaggcggaggatctggcggcggaggctctgatattcagatgacacagagccccagcagcctgtctgcctctgtgggagacagagtgaccatcacctgtagagccagccagagcatcagcagctacctgaactggtatcagcagaagcccggcaaggcccctaaactgctgatctatgccgcctccagtctgcagagcggagtgcctagcagattttctggctctggcagcggcaccgacttcaccctgacaatatctagcctgcagcctgaggacttcgccacctactactgccagcagagctacatcacccctctgacattcggtggcggcaccaaggtggaaatcaag

SEQ ID NO: 333 - DNA, 756 bp, Artificial Sequence
  Synthetic Polynucleotide
gacatcgtgctgacacagagccctgcttctctggccgtgtctcttggacagggcgctaccatcagctgtagagccagcaagagcgtgtccaccagcggctacacctacatgcactggtatcagcagaagcccggccagcctcctaagctgctgatctacctggcctccaacctggaaagcggagtgcctgccagattttctggcagcggctctggcaccgacttcaccctgaatatccatcctgtggaagaagaggacgccgccacctactactgtcagcactctggcgaactgccacctagctttggcggaggcaccaagctggaaatcaagagagctggcggaggcggaagtggaggcggaggatctggcggcggaggctctgaagtgcagctggtggaatctggcggcgaccttgtgaaacctggcggctctctgaagctgagctgtgccgtgtccggcttcacctttagcagctacggcatgagctgggtccgacagacccctgacaagagactggaatgggtcgccacagtgtctagcggcggcacctacacatattaccccgacagcgtgaagggcagattcaccatcagccgggacaacgccaagaacaccctgtacctccagatgagcagcctgaagtccgaggacagcgccatgtactactgcgccagacaccggggcaattactacgccacctattattacgctatggactactggggccagggcaccagcgtgacagtttcttct

SEQ ID NO: 334 - DNA, 729 bp, Artificial Sequence
  Synthetic Polynucleotide
gacgtgcagatcacacagagccctagctacctggctgcctctcctggcgagacaatcaccatcaactgtcgggccagcaagagcatcagcaagtacctggcctggtatcaagagaagcccggcaagaccaacaagctgctgatctacagcggcagcacactccagtctggcatccccagcagattttccggctctggcagcggcaccgatttcaccctgaccataagcagcctggaacctgaggacttcgccatgtactactgccagcagcaccacgaatacccctacacctttggcggaggcaccaagctggaaatcaaaggaggaggcggaagtggaggcggaggatctggcggcggaggctctcaggttcagctgcaacagcctggcgctgaactcgttagacctggcgcttctgtgaagctgagctgcaaggccagcggctacaccttcaccacctactggatgaactgggtcaagcagcggcctgagcagggcctcgaatggatcggcagaatcgacccctacgacagcgagacacactacaaccagaagttcaaggacaaggccatcctgaccgtggacaagagcagctccacagcctacatgcagctgagcagcctgaccagcgaggatagcgccgtgtactattgcgccagaggaccctactacggaacaaacccctggtttccctattggggccagggcacactggtcaccgttagctct

SEQ ID NO: 335 - DNA, 738 bp, Artificial Sequence
  Synthetic Polynucleotide
gacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaaggcggaggcggaagtggaggcggaggatctggcggcggaggctctgaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttct

SEQ ID NO: 336 - DNA, 747 bp, Artificial Sequence
  Synthetic Polynucleotide
gacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaaggcggaggcggaagtggaggcggaggatctggcggcggaggctctcaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttct

SEQ ID NO: 337 - DNA, 738 bp, Artificial Sequence
  Synthetic Polynucleotide
caggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcggcggaggcggaagtggaggcggaggatctggcggcggaggctctgatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaag

SEQ ID NO: 338 - DNA, 729 bp, Artificial Sequence
  Synthetic Polynucleotide
gaggttcagctgcttgagtctggcggaggactggttcaacctggcggaagcctgagactgtcttgtgccgccagcggcttcacctttagcagctacgccatgagctgggtccgacaggctcctggcaaaggactggaatgggtgtccgtgatctctggctctggcggcagacccaattacgccgattctgtgaagggcagattcaccatcagccgggacaacagcaagaacaccctgtacctccagatgaacagcctgcgcgacgaggataccgccgtgtactattgtgccaaggtggactacagcaactacctgttcttcgactactggggccagggcaccctggtcacagtttctagcggcggaggcggaagtggaggcggaggatctggcggcggaggctctgaaatcgtgctgacacagagccccggcacactgtcactttctccaggcgaaggcgctaccctgtcttgtagagctggacagtctgtgcggagcagctacctcggatggtatcagcagaagcctggacaggcccctcggctgttgatctacggtgcttctagcagagccacaggcatccccgatagattttctggcagcggctccggcaccgacttcaccctgacaatcagcagactggaacccgaggacttcgccgtgtattactgccagcagtacggctacagccctcctacatttggcggaggcaccaagctggaaatcaag

SEQ ID NO: 339 - DNA, 747 bp, Artificial Sequence
  Synthetic Polynucleotide
caggttcagctgcaagagtctggccctggcctggtcaagcctagccaaacactgagcctgacctgtaccgtgtctggcggctctattagcagaggcggctactactggtcctggatcagacagcaccctggcaaaggactggaatggatcggctacatcttctaccggggcagaacctactacaaccccagcctgaagtccagagtgaccatcagcgtggacaccagcaagaaccagttctccctgaagctgagcagcgtgacagccgccgatacagccgtgtactactgcgccagagtgaacagcaactacggatggttcgacccttggggccagggcacactggttacagtttctagtgcttccggcggaggcggaagtggaggcggaggatctggcggcggaggctctgaaattgtgctgacacagttccccggcacactgtctcttagccctggcgaaagagccacactgagctgtagagccagccagtccgtgtccagctcttacctggcttggtatcagcagaagcccggacaggctcccagactgctgatctacggtgcctctagcagagccacaggcatccccgatagattttctggcagcggctccggcaccgacttcaccctgacaatcagcagactggaacccgaggacttcgccgtgtattattgccagcagtacggcagcagccctctgacatttggcggcggaacaaagctggaaatcaagacagtggctgcc

SEQ ID NO: 340 - DNA, 756 bp, Artificial Sequence
  Synthetic Polynucleotide
caggtgcagctggttgaatctggtggcggagttgttcagcctggcggctctctgagactgtcttgtgccgccagcggcttcaccttcagcagctatggaatgcactgggtccgacaggcccctggcaaaggacttgagtgggtcgccttcatttggtacgacggcagcaacaagtattacgccgacagcgtgaagggcagattcaccatctccagagacaacagcaagaacaccctgtacctccagatgaacagcctgagagccgaggacaccgccgtgtactattgtgctcggagagccggcatcatcggcaccatcggctactactacggcatggatgtgtggggccagggcaccacagtgacagtttctagtgcttccggcggaggcggaagtggaggcggaggatctggcggcggaggctcttcttatgagctgacccagcctccaagcgtgtccgtgtctcctggacagacagccagcatcacctgtagcggcgatagactgggcgagaagtacacctcctggtatcagcagaggcccggacagtctcctctgctggtcatctaccaggacaccaagaggccaagcggcatccccgagagattcagcggcagcaatagcggcaataccgccacactgaccatcagcggcacccaggctatggacgaggccgactactattgccaggcttgggagagcagcaccgtggtttttggcggaggcacaaagctgaccgtgctgacagtggctgcc

SEQ ID NO: 341 - DNA, 765 bp, Artificial Sequence
  Synthetic Polynucleotide
gacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccggcggaggcggaagtggaggcggaggatctggcggcggaggctctcaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttcc

SEQ ID NO: 342 - DNA, 759 bp, Artificial Sequence
  Synthetic Polynucleotide
gacgtggtcatgacacagacccctctgagcctgcctgtgacacctggcgaacctgccagcatcagctgtagaagcagccagagcatcgtgcacagcaacggcaacacctacctggaatggtatctccagaagcctggacagagccccaagctgctgatctacaagctgagcaacagattcagcggcgtgcccgacagattttctggcagcggctctggcaccgacttcaccctgaagattagcagagtggaagccgaggacgtgggcgtgtacttctgtagccaaggctctcacttcccctacaccttcggccagggcaccaagctggaaatcaagagaacagtggctgccggcggaggcggaagtggaggcggaggatctggcggcggaggctctgaagttcagctggttcagtctggggccgaagtgaagaagccaggcgagagcctgaaaatcagctgccaggctttcggctacacctttagcacccactggatcgagtggatcagacagatgccaggccagggcctcgaatggatcggagagattctgcctggaagcggcagcaccagctacaacgagaagttcaaaggccaggccacactgagcgccgacaagtctagcagcacagcctacctccagtggtcctctctgaaggccagcgacaccgccatgtacttttgcgccagatggctgctgtactactacgctatggactactggggccagggaacaatggtcaccgtgtctagtgcttcc

SEQ ID NO: 343 - DNA, 747 bp, Artificial Sequence
  Synthetic Polynucleotide
gacatccagatgacacagagccctagcagcctgtctgccagcgtgggagacagagtgaccatcacctgtagagccagccagagcatcgacacccggctgaactggtatcagcagaagcctggcaaggcccctaagctgctgatctactctgccagctctctccagagcggcgtgccaagcagattttctggcagcggctctggcaccgacttcaccctgacaatatccagcctccagcctgaggacttcgccacctactactgtcagcagagcgcctacaatcccatcaccttcggccagggcaccaaggtggaaatcaagagaacagtggctgccggcggaggcggaagtggaggcggaggatctggcggcggaggctctcaagttcagctggttcagtctggggccgaagtgaagaaacctggcagcagcgtgaaggtgtcctgcaaagcaagcggcggcacctttagcagctacgccatctcttgggtccgacaggctcctggacaaggactggaatggatgggcggcatcatccccatcttcggcacagccaattacgcccagaaattccagggccgcgtgacaatcacagccgacgagtctacaagcaccgcctacatggaactgagcagcctgagaagcgaggacaccgccgtgtactactgtgccagaagctcctacggctggtcctacgagttcgactattggggccagggaaccctggtcacagtgtctagtgcttcc

SEQ ID NO: 344 - DNA, 726 bp, Artificial Sequence
  Synthetic Polynucleotide
gaagtgcagcttcagcagtctgccgccgaacttgctagacctggcgcttctgtgcggatgagctgtagaaccagcggctacaccttcaccacctacaccatccactggatgaagcagcggcctggacagggccttgagtggatcggctacatcaaccccaacggcggctataccgagtacaaccagaagttccgggacagaaccacactgaccgccgacaagtctagcagcaccgcctacatgcagctgagcagcctgacaagcgaggacagcgccgtgtactactgcaccagaaacttcgactactggggccagggcacaaccctgacagtgtctagtgcttctggcggaggcggaagtggaggcggaggatctggcggcggaggctctgacattgtgatgacacagagccccagctctatgtacgccagcctgggagagagagtgaccattacctgcaaggccagccaggacatcaacagctacctgagctggttccagcagaagcccggcaagagccccaagacactgatctacagagtgaaccggctggtggatggcgtgcccagcagattttctggctctggcagcggccaggattacagcctgaccatcagcagcctggaatacgaggacgtgggcatctactactgcctccagtacgacgagttccctctgacactcggagccggcacaaagctggaactgaagagaacagtggccgcc

SEQ ID NO: 345 - DNA, 729 bp, Artificial Sequence
  Synthetic Polynucleotide
gaggttcagctgcttgagacaggcggaggactggttcaacctggcggaagcagaggactgagctgtgaaggcagcggctttaccttcagcggcttctggatgagctgggtccgacagacacctggcaagaccctggaatggatcggcgacatcaatagcgacggcagcagcatcaactacgcccctagcatcaaggacaggttcaccatcttccgggacaacgacaagagcatcctgtacctccagatgaccaacgtgcggagcgaggacaccggcacctacttttgtgtgaccacctacggcgactactggggccagggaacaaccctgacagtgtctagtgcttctggcggaggcggaagtggaggcggaggatctggcggcggaggctctgatattgtgatgacccagagccagaaattcatgagcaccagcgtgggcgacagagtgtccgtgacatgtaaagccagccagaacgtgggctctcacgtcggctggtatcagcagaagtctggacagagccccaaggcactgatctacagcgccagcaatcggtacatcggcgtgcccgatagattcaccggctctggcagcggcaccgatttcaccctgaccatcagcaacgtgcagtccgaggacctggccgagtatttctgccagcagtaccacatctacccctacacctttggaggcggcacccggctggaaatcaagagaacagtggctgcc

SEQ ID NO: 346 - DNA, 756 bp, Artificial Sequence
  Synthetic Polynucleotide
gaagtgcagctggttcagtctggggccgaagtgaagaagcctggcgagagcctgaagatcagctgccaggctttcggctataccttcaccagcttttggatgcactggatcagacagatgcccggccagggcctcgaatggatcggagtgatcgatcccagcgacacctacaccaactacaaccagaagttcaaaggccaggccacactgagcgccgacaagtctagcagcacagcctacctccagtggtcctctctgaaggccagcgataccgccatgtacttttgcgccagaggcgactacagcaactggttcacatattggggccagggcacaatggtcaccgtgtcatctgcatctggcggaggcggaagtggaggcggaggatctggcggcggaggctctgatgtggtcatgacacagacccctctgagcctgcctgtgacacctggcgaacctgccagcatcagctgtagaagcagccagagactggtgcacagcaacggcaacacctacctgcactggtatctccagaagccaggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccatgtgccttggacctttggacaggggaccaagctggaaatcaagagaacagtggctgcc

SEQ ID NO: 347 - DNA, 744 bp, Artificial Sequence
  Synthetic Polynucleotide
caggttcagctgcaacagtctggggccgaagtgaagaaacctggggcctctgtgaaggtgtcctgtgaagccagcggctacacattccccagctacgtgctgcactgggtcaaacaggctccaggccaaggactggaatggatcggctacatcaacccctacaacgacggcacccagtacaacgagaagttcaagggcaaagccacactgaccagagacaccagcatcaacaccgcctacatggaactgagccggctgagatccgatgacaccgccgtgtactattgcgccagaggctttggcggcagctacggctttgcttattggggccagggcaccctggtcacagtgtcatctgcatctggcggaggcggaagtggaggcggaggatctggcggcggaggctctgatattcagctgacacagagcccctccagcctgtctgcctctgtgggagatagagtgaccatgacctgtagcgccagcagcagcgtgtccagcagctacctgtggtatcagcagaagcctggcaaggcccctaagctgtggatctacagcaccagcaatctggcctcaggcgtgccagccagattttctggctctggcagcggcaccgatttcaccctgacaatatccagcctccagccagaggacagcgccagctacttttgccaccagtggaacagatacccctacacctttggcggaggcacccggctggaaatcaagagaacagtggctgcc

SEQ ID NO: 348 - DNA, 747 bp, Artificial Sequence
  Synthetic Polynucleotide
caggtgcagctgaagcagtctggacctggactggtgcagcctagccagagcctgagcatcacctgtaccgtgtccggcttcagcctgaccagatttggcgtgcactgggtccgacagagccctggcaaaggactggaatggctgggagtgatttggagaggcggcagcaccgattacaacgccgccttcatgagccggctgaccatcaccaaggacaacagcaagagccaggtgttcttcaagctgaacagcctgaaggtggacgacaccgccatctactactgctccaaccactactacggcagcagcgactacgccctggataattggggccagggcatcagcgtgacagtgtctagtgcttctggcggaggcggaagtggaggcggaggatctggcggcggaggctctgatattgtgatgacccagagccacaagatcatgagcaccagcgtgggcgacagagtgtccatcacatgcaaagccagccaggacgtgtccaacatcgtcgtgtggttccagcagaagcccggccagtctcctaacctgctgatctacagcgccagctacagatacaccggcgtgcccgatagattcacaggcagcggctctggcaccgacttcacctttacaatcagcagcgtgcaggccgaggacctggccgtgtattattgccagcagcactacagcagcccctacacctttggcggaggcaccaagctggaaatcaagagaacagtggccgcc

SEQ ID NO: 349 - DNA, 747 bp, Artificial Sequence
  Synthetic Polynucleotide
gaggtgcagctggttgaatctggcggaggactggttcagcctggcggatctctgagactgtcttgtgccgccagcggcttcaccatcaccaactatggcatccactgggtccgacaggcccctggcaaaggacttgagtgggtcggaagaatctaccccgatagcggagccacctactacgccgattctgtgaagggcagattcaccatctccgccgacaccagcaagaacaccgcctacctccagatgaacagcctgagagccgaggacaccgccgtgtactactgtgccagaaagctgtggatctctatcgccggcatggactattggggccagggcacactggtcacagtgtcatctgcatctggcggaggcggaagtggaggcggaggatctggcggcggaggctctgacattcagatgactcagagccctagcagcctgagcgcctctgtgggagacagagtgaccatcacctgtagagccagccaggatgtgtctacagccgtggcctggtatcagcagaagcctggaaaggcccctaagctgctgatctacagcgccagcttcctgtacagcggcgtgccaagcagattttctggcagcggctctggcaccgacttcaccctgacaatatccagcctccagcctgaggacttcgccacctattactgccagcacagctacgccacacctttcacattcggacagggcaccaaggtggaaatcaagagaacagtggccgcc

SEQ ID NO: 350 - DNA, 747 bp, Artificial Sequence
  Synthetic Polynucleotide
gacatccagatgacacagagccctagcagcctgtctgccagcgtgggagacagagtgaccatcacatgcaaggccagccagaacgtgcggaccaccgtggattggtatcagcagaagcctggcaaggcccctaagctgctgatctacctggcctccaatagacacaccggcgtgcccagcagattttctggctctggcagcggcaccgacttcaccctgacaatatctagcctccagcctgaggacttcgccacctactactgcctccagcaccggaactaccctctgacatttggcggaggcaccaaggtggaaatcaagagaacagtggctgccggcggaggcggaagtggaggcggaggatctggcggcggaggctctgaagtgcagctggttgaatctggcggcggactggttaagcctggcggatctctgagactgagctgtgccgccagcggcttcaccttcagcagctacgatatgagctgggtccgacaggcccctggcaaaggacttgaatgggtgtccacaatcagcagcggcggcaactacaactactaccccgacagcgtgaagggcagattcaccatctccagagacaacgccaagaacagcctgtacctccagatgaactccctgagagccgaggacaccgccgtgtactattgcgccagacactacgactaccctgactacgctatggactactggggccagggcaccaccgtgacagttagctctgcttct

SEQ ID NO: 351 - DNA, 738 bp, Artificial Sequence
  Synthetic Polynucleotide
gacatccagatgacacagagccctagcagcctgtctgccagcgtgggagacagagtgaccatcacatgtagcgccagccagggcatcagaaactacctgaactggtatcagcagaaacccggcaaggtgcccaagctgctgatctactacaccagcagactgcacagcggcgtgcccagcagattttctggctctggcagcggcaccgacttcaccctgacaatatctagcctccagcctgaggacgtggcaacctactactgtcagcagtacggcaagctgccctacacattcggccagggcaccaagctggaaatcaagagaacagtggctgccggcggaggcggaagtggaggcggaggatctggcggcggaggctctgaagttcagctggttgaatcaggcggcggactggttcaacctggcggatctctgagactgagctgtgccgccagcggcttcacattttccgacgcctggatggactgggtccgacaggctcctggaaaaggactggaatgggtcggagagatccggtccaaagtgaacaaccacgaaacctactatgccgagagcgtgaagggcagattcaccatcagccgggacgacagcaagaacagcctgtacctccagatgaactccctgaaaaccgaggacaccgccgtgtactactgcgccagaaacgactacttcgactactggggccagggaaccaccgtgacagtgtctagtgcttcc

SEQ ID NO: 352 - DNA, 732 bp, Artificial Sequence
  Synthetic Polynucleotide
gacatccagatgacacagagccctagcagcctgtctgcctctctcggcggcaaagtgaccatcacctgtagagccagccaggacatcaacaagttcatcagctggtatcagcacaggcccggcaagggacctagactgctgatccactacgccagcacactccagcctggcatccctagcagattttccggctctggcagcggcagagactacagcttcagcatcagcaacctggaacctgaggacattgccacctactactgcctccagtacgacaacctgtggacctttggcggaggcaccaagctggaaatcagaacagttgctgctggcggaggcggaagtggaggcggaggatctggcggcggaggctctgaagttcagctccagcagagcggccctgagcttgtgaaacctggcgcttctgtgcggatgagctgtaaagccagcggctacaccttcaccgactacaacatgtactgggtcaagcagagcctgggcaagagcctggaatggatcggctacatctaccccaataccggcggagccacctacaaccagaagttcaagggcaaagccacactgaccgtgaacaagagcagcagcaccgccttcatggaactgagaagcctgaccagcgaggacagcgccgtgtactattgtggaagaggcggcctgggacctttcgcctattggggacagggaaccctggtcacagtgtctgctgcttct

SEQ ID NO: 353 - DNA, 735 bp, Artificial Sequence
  Synthetic Polynucleotide
cagagcctggaagaatctggcggcggacttgtgaagcctggcggaacactgaccctgatctgtaccgtgtctggcatcgacctgagcacctacggcgtgatctgggttcgacaggcccctagagaaggactggaatggatcggcttcatcaccagaagcggcaccacagattatgccgcctgggccaatggccggttcaccatcagcaagaccagcaccaccgtggacctgaagatcgcctctctgacagccgccgataccgccacctacttttgtgccagaggcggctacagattcaacctgtggggccacggaaccctggtcacagtttctagtgcttccggcggaggcggaagtggaggcggaggatctggcggcggaggctctgatcctgtgatgacacagacacccgccagcgtgtccgaacctgttggaggcacagtgaccatcaagtgccaggccagccagagcatctacagctacctggcctggtatcagcagaagcccggacagcctcctaagctgctgatctacaaggccagcagcctggaaagcggcgtgccaagtagactgtctggcagcggatctggcaccgagttcaccctgaccatcagcgatctggaatgtgccgacgccgccacttactactgtcaaggcggctatatcagcaccacagtgtccttcggctacggctttggcggaggaacagaggtggtggtcaagacagtggctgcc

SEQ ID NO: 354 - DNA, 765 bp, Artificial Sequence
  Synthetic Polynucleotide
gaggtgcagctggttgaatctggcggaggactggttcagcctggcggatctctgagactgtcttgtgccgccagcggcttcaccttcagcgacttcgatatggaatgggtccgacaggcccctggcaaaggactcgaatgggttggagccagccggaacaaggccaacgactacaccacacagtacagcgccagcgtgaagggcagattcaccatcagcagagacaccagcaagaacagcctgtacctccagatgaactccctgaaaaccgaggacaccgccgtgtactactgcgccagagacagatacgactacgccctggattattggggccagggcaccaccgtgacagtgtcaagtgcttctggcggaggcggaagtggaggcggaggatctggcggcggaggctctgacattcagatgacacagagccctagcagcctgagcgcctctgtgggagacagagtgaccatcacatgcaagagcagccagacactgctgtactactccaaccagaagaactacctggcctggtatcagcagaaacccggcaaggtgcccaagctgctgatctactgggccagcacaagagatagcggcgtgcccagcagattttctggcagcggctctggcaccgacttcaccctgacaatatccagcctccagcctgaggacgtggcaacctactactgccagcagtattacaactaccctctgaccttcggccaggggaccaagctggaaatcaagagaacagtggccgcc

SEQ ID NO: 355 - DNA, 753 bp, Artificial Sequence
  Synthetic Polynucleotide
caggttcagctggttcagtctggggccgaagtgaagaaacctggggcctctgtgaaggtgtcctgcaaggccagcggcttcaacatcaaggacacctacatccactgggtccgacaggcccctggacaaggacttgagtggatgggcagaatcgaccccgccaacggcaaggccaactacgaccctaagttccagggcagagtgaccatgaccagagacaccagcacctccaccgtgtacatggaactgagcagcctgagaagcgaggacaccgccgtgtactattgtgctctcggcggaggctactacggcatggattattggggccagggcaccctggtcacagtgtcatctgcatctggcggaggcggaagtggaggcggaggatctggcggcggaggctctgacatcgtgatgacacagagccccgatagcctggccgtgtcactgggagaaagagccaccatcaactgtcgggccagcgagtccgtggacagctacggcaatagcttcatgcactggtatcagcagaagcccggccagcctcctaagctgctgatctacctggcctccaacctggaaagcggcgtgcccgatagattttctggcagcggctctggcaccgacttcaccctgacaattagcagcctccaggccgaggatgtggccgtgtattactgccagcagaacaacgaggaccctctgacattcggacagggcaccaaggtggaaatcaagagaacagtggccgcc

SEQ ID NO: 356 - DNA, 723 bp, Artificial Sequence
  Synthetic Polynucleotide
gaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctggcggaggcggaagtggaggcggaggatctggcggcggaggctctgagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgcc

SEQ ID NO: 357 - DNA, 732 bp, Artificial Sequence
  Synthetic Polynucleotide
gacatccagatgacccagagcccctctagcctgagcgccagcgtgggcgacagagtgaccatcacctgtcgggccagccaggacatcagaaactacctgaactggtatcagcagaagcccggcaaggcccccaagctgctgatctactacacctctagactggaaagcggcgtgcccagccggtttagcggcagcggctccggcaccgactacaccctgaccatcagcagcctgcagcccgaggacttcgccacctactactgccagcagggcaacacactcccctggaccttcggccagggcaccaaggtggagatcaagggcggaggcggaagtggaggcggaggatctggcggcggaggctctgaggtgcagctggtcgagagcggaggcggcctggtgcagcctggcggcagcctgagactgagctgcgccgccagcggctacagcttcaccggctacaccatgaactgggtccggcaggcacctggcaagggactggaatgggtggccctgatcaacccctacaagggcgtgagcacctacaaccagaagttcaaggaccggttcaccatcagcgtggacaagagcaagaacaccgcctatctgcagatgaacagcctgcgggccgaggacaccgccgtgtactactgcgccagaagcggctactacggcgacagcgactggtacttcgacgtgtggggccagggcaccctcgtgaccgtgtctagc

SEQ ID NO: 358 - DNA, 762 bp, Artificial Sequence
  Synthetic Polynucleotide
gaggttcagctgcaagagtctggggccgaagtgaagaaacctggcagcagcgtgaaggtgtcctgcaaggccagcggcttcaacatcaaggacacctacatgcactgggtccgacaggcccctggacaaggacttgagtggatgggcagaatcgaccccgccaacggcaacagcaaatacgtgcccaagttccagggcagagtgaccatcacagccgacgagagcacaagcaccgcctacatggaactgagcagcctgagaagcgaggacaccgccgtgtactactgtgcccctttcggctactacgtgtccgactacgccatggcctattggggccagggaaccaccgtgacagtgtctagtgcatctggcggaggcggaagtggaggcggaggatctggcggcggaggctctgacatcgtgatgacacagagccccgatagcctggccgtgtctctgggagaaagagccaccatcaactgtagagccggcgagagcgtggacatcttcggcgtgggatttctgcactggtatcagcagaagcccggccagcctcctaagctgctgatctacagagccagcaacctggaaagcggcgtgcccgatagattttctggcagcggctctggcaccgacttcaccctgacaatcagacctctccaggccgaggatgtggccgtgtattattgccagcagaccaacgaggacccctacacatttggacagggcaccaagctggaaatcaagagaacagtggccgcc

SEQ ID NO: 359 - DNA, 741 bp, Artificial Sequence
  Synthetic Polynucleotide
caagttcagctggttcagtctggggccgaagtgaagaaacctggcagcagcgtgaaggtgtcctgcaaagcaagcggcggcacctttagcagctacgccatctcttgggtccgacaggcaccaggacaaggactggaatggatgggcctgattatccccagatacggcaaggccagatacgcccagaaattccagggcagagtgaccatcaccgccgacgagtctacaagcaccgcctacatggaactgagcagcctgagaagcgaggacacagccgtgtattattgcgcccggaactggccctactactacatggatttttggggccagggaaccctggtcaccgtgtctagtgcatctggcggaggcggaagtggaggcggaggatctggcggcggaggctctgacatcgtgctgacacagtctcccgccacactgtcactgtctccaggcgaaagagccacactgagctgtagagccagccagaacatcgtgttcaacctggcctggtatcagcagaagcctggacaggctccccggctgctgatctacgatgccagcaatagagccaccggcgtgcccgccagattttctggttctggcagcggcaccgacttcaccctgaccatatctagcctggaacctgaggacttcgccgtgtactactgccagcagaaaaagtccatgcctctgaccttcggccagggcaccaaggtggaaatcaagagaacagtggctgcc

SEQ ID NO: 360 - DNA, 750 bp, Artificial Sequence
  Synthetic Polynucleotide
gaggtgcagctggttgaatctggcggcggacttgtgaagcctggcggatctctgagactgagctgtgccgccagcggcttcacctttagcaatgcctggatgagctgggtccgacaggcccctggaaaaggactggaatgggtcggacggatcaagagcaagaccgaaggcggcaccaccgattatgctgcccctgtgaagggcagattcaccatcagcagggacgacagcaagaacaccctgtacctccagatgaacagcctgaaaaccgaggacaccgccgtgtactactgcaccacaccttacgagtggtcttggtacgactactggggccagggcacactggtcacagtgtcatctgcatctggcggaggcggaagtggaggcggaggatctggcggcggaggctctcagacagtggtcacccaagagcctagcctgacagtgtctcctggcggaaccgtgacactgacatgtggcagttctaccggcgctgtgaccaccagcaattacgccaactgggtgcagcagaagccaggccaagctcctagaggactgatcggcggcacaaacaagagagcccctggcacaccagccagattttctggctctctgctcggcggaaaggccgctcttacactgtctggtgtccagcctgaggacgaggccgagtattattgcgccctgtggtacagcaacctgtgggttttcggcggaggcaccaagctgacagtgctgactgttgctgct

SEQ ID NO: 361 - DNA, 750 bp, Artificial Sequence
  Synthetic Polynucleotide
caggttcagctggttcagtctggggccgaagtgaagaaacctggggcctctgtgaaggtgtcctgcaaggcttccggctacacctttaccagctactacatgcactgggtccgacaggcccctggacaaggacttgagtggatgggcatcatcaaccctagcggcggcagcacaagctacgcccagaaattccagggcagagtgaccatgacacacgacaccagcacctccaccgtgtacatggaactgagcagcctgagaagcgaggacaccgccgtgtactactgcgccagatccttcttcaccggcttccacctggattactggggccagggaacactggtcacagtgtcatctgcatctggcggaggcggaagtggaggcggaggatctggcggcggaggctctgaaattgtgctgacacagagccccggcacactgtcactttctccaggcgaaagagccacactgagctgtagagccagccagagcgtgtccagctcttacctggcttggtatcagcagaagcccggccaggctcctagactgctgatctacggtgccagcagcagagccacaggcatccccgatagattttctggcagcggctccggcaccgacttcaccctgacaatcagcagactggaacccgaggactttgccgtgtattattgccagcagtacaccaacgagcactactacaccttcggccagggcaccaaggtggaaatcaagagaacagtggccgcc

SEQ ID NO: 362 - DNA, 768 bp, Artificial Sequence
  Synthetic Polynucleotide
gagatcgtgctgacacagtctcccgccacactgtcactgtctccaggcgaaagagccacactgagctgtagcgtgtccagcagcatcagcagcagcaacctgcactggtatcagcagaagcctggacaggcccctcggctgctgatctacggcacatctaatctggcctctggcatccccgccagattttctggctctggaagcggcaccgacttcaccctgaccataagcagcctggaacctgaggacttcgccgtgtactactgccagcagtggtccagctatccccacacatttggcggaggcaccaaggtggaaatcaagagaacagtggctgccggcggaggcggaagtggaggcggaggatctggcggcggaggctctcaggttcagctggttcagagcggagccgaagtgaagaaacctggggcctctgtgaaggtgtcctgcaaggcttccggctacacctttaccaactacctgatcgagtgggtccgacaggctccaggacaaggactggaatggatgggcctgattaaccctggcagcggcggcaccaactacaacgagaagttcaagggcagagtgaccatgaccaccgacaccagcacaagcaccgcctacatggaactgcggagcctgagaagcgacgacaccgccgtgtattattgcgccagaagaagccctctcggctcttggatctactacgcctatgacggcgtggcctattggggccagggaacactggttacagtgtcctctgccagc

SEQ ID NO: 363 - DNA, 723 bp, Artificial Sequence
  Synthetic Polynucleotide
gacatccagatgacacagagccctagcagcctgtctgccagcgtgggagacagagtgaccatcacctgtaaagccggccagaacgtgggcacaagcgtggcatggtatcagcagaagcctggcaaggcccctaagctgctgatctacagcgccagctacagatacagcggcgtgcccagcagattttctggcagcggctctggcaccgacttcaccctgacaatatccagcctccagcctgaggacttcgccacctactactgccagcagtacatcacatacccctacaccttcggccagggcaccaaggtggaaatcaagagaacagtggctgccggcggaggcggaagtggaggcggaggatctggcggcggaggctctgaagttcagctggttgaatcaggcggcggactggttcaacctggcggatctctgagactgagctgtgccgccagcggcttcaccttcagcagatactggatgagctgggtccgacaggcccctggcaaaggacttgaatgggtcgccgagatcaaccccgacagcagcaccatccagtacaccccatctctgaaggcccggttcaccctgtccgtggacagaagcaagaacaccctgtacctccagatgaactccctgagagccgaggacaccgccgtgtactattgtgccagacctgcctattggggccagggaacactggtcacagtgtctagcgcttcc

SEQ ID NO: 364 - DNA, 738 bp, Artificial Sequence
  Synthetic Polynucleotide
gacatcgtgctgacacagtctcccgccacactgtcactgtctccaggcgaaagagccacactgagctgtagagccagccagagcatcagcaacaacctgcactggtatcagcagaaccccggacaggctcccagactgctgatctactacggcagccagtccatcagcggcatccctgccagattttctggcagcggctctggcaccgatttcaccctgaccataagcagcctggaacctgaggacttcgccgtgtactactgccagcagagcaatagctggcccctgacatttggcggaggcaccaagctggaaatcaagagaacagtggctgccggcggaggcggaagtggaggcggaggatctggcggcggaggctctgaagttcagctgcaagagtccggcgctgaagtgaagaaacctggggcctctgtgaaggtgtcctgcaaggccagcggctacagctttaccggctacaccatgaactgggtccgacaggcacctggacagggccttgaatggatgggcctgattaacccctacaacggcggcaccacctacaaccagaaattcaagggcaaagtgaccatgaccagggacaccagcatcagctccgcctacatggaactgagccggctgagatccgatgacaccgccgtgtattattgcgccagagactgggactactacttcgacgtgtggggccagggcacaaccgtgacagtttcttctgccagc

SEQ ID NO: 365 - DNA, 759 bp, Artificial Sequence
  Synthetic Polynucleotide
gacatcgtgatgacacagagccctgatagcctggccgtgtctctgggagagagagccaccatcaactgcaagagcagccagagcctgctgaacagcggcaaccagaagaactacctgacctggtatcagcagaagcccggccagcctcctaagctgctgatctactgggccagcaccagagaaagcggcgtgcccgatagattttctggctctggcagcggcaccgacttcaccctgacaatttctagcctgcaagccgaggacgtggccgtgtactactgccagaacgactacagctaccctctgaccttcggccagggcaccaaggtggaaatcaagagaacagtggctgccggcggaggcggaagtggaggcggaggatctggcggcggaggctctcaagttcagctggttcagtctggggccgaagtgaagaaacctggcagcagcgtgaaggtgtcctgcaaggccagcggctacagcttcaccagcaactggatgcactgggtccgacaggctccaggacaaggactggaatggatgggcgtgatcgaccccagcgacacctacatcagctacaaccagaaattcaagggccgcgtgaccatcaccgccgatgagtctacaagcaccgcctacatggaactgagcagcctgagaagcgaggacaccgccgtgtattattgcgccagaagagacagcggctggtacttcgatgtgtggggccagggaacactggtcacagtgtctagcgcttcc

SEQ ID NO: 366 - DNA, 768 bp, Artificial Sequence
  Synthetic Polynucleotide
gacatcgtgatgacacagagccctgatagcctggccgtgtctctgggagagagagccaccatcaactgcaagagcagccagagcctgctgaacagcggcaaccagaagaactacctgacctggtatcagcagaagcccggccagcctcctaagctgctgatctactgggccagcaccagagatagcggcgtgcccgatagattttctggctctggcagcggcaccgacttcaccctgacaatttctagcctgcaagccgaggacgtggccgtgtactactgccagaacgactacagctaccctctgaccttcggccagggcaccaaggtggaaatcaagagaacagtggctgccggcggaggcggaagtggaggcggaggatctggcggcggaggctctcaagttcagctggttcagtctggggccgaagtgaagaaacctggcagcagcgtgaaggtgtcctgcaaggcttccggctacacctttaccagctactggatgcactgggtccgacaggctccaggacaaggactggaatggatgggcaacatcgaccccagcgacagcgaaatctactacaaccagaaattcaaggaccgcgtgaccatcaccgccgacgagtctacaagcaccgcctacatggaactgagcagcctgagaagcgaggacaccgccgtgtattattgcgccagaagaagcggcagccgggactactacggcatggatgattggggccagggaaccctggtcacagtgtctagtgcttcc

SEQ ID NO: 367 - DNA, 747 bp, Artificial Sequence
  Synthetic Polynucleotide
gacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccggcggaggcggaagtggaggcggaggatctggcggcggaggctctgaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagc

SEQ ID NO: 368 - DNA, 759 bp, Artificial Sequence
  Synthetic Polynucleotide
gacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccggcggaggcggaagtggaggcggaggatctggcggcggaggctctcaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttcc

SEQ ID NO: 369 - DNA, 747 bp, Artificial Sequence
  Synthetic Polynucleotide
gaggtgcagctggtggaatctggacctgctctggtcaagcccacacagaccctgacactgacctgtaccgtgtccggctttagcctgaccggctacagcgtgaactggatcagacagcctcctggcaaggccctggaatggctgggaatgatctggggagatggcagcaccgactacaacagcgccctgaagtccagactgaccatcagcaaggacaccagcaagaaccaggtggtgctgaccatgaccaacatggaccctgtggacaccgccacctactactgcgccagagactactacttcaactacgccagttggttcgcctactggggccagggaacactggtcacagtgtcatctgcatctggcggaggcggaagtggaggcggaggatctggcggcggaggctctgacatccagatgacccagtctccaagcagcctgtctgccagcgtgggcgacagagtgacaatcacatgtagcgccagccagggcatcagcaactacctgaattggtatcagcagaaacccggcaagaccgtgaagctgctgatctactacacctccaacctgcacagcggcgtgcccagcagattttctggctctggcagcggcaccgattacaccctgacaatatccagcctccagcctgaggacttcgccacatattactgccagcagtacagcgagctgccctggacatttggacagggcaccaaggtggaaatcaagagaacagtggccgcc

SEQ ID NO: 370 - DNA, 777 bp, Artificial Sequence
  Synthetic Polynucleotide
gaggtgcagctggttgaatctggcggaggactggttcagcctggcggatctctgagactgagctgtgccgtgtctggctacagcatcaccagcgactacgcctggaactgggttcgacaggcccctggcaaaggactggaatgggtcggatatatcagcaacagcggcagcaccagctacaaccccagcctgaagtcccggttcaccatcagcagagacaccagcaagaacaccctgtacctccagatgaacagcctgagagccgaggacaccgccgtgtactattgcgccagagagcggaactacgactacgacgattactactacgctatggactactggggccagggcaccctggttacagtgtcaagtgcttctggcggaggcggaagtggaggcggaggatctggcggcggaggctctgacattcagatgacacagagccctagcagcctgagcgcctctgtgggagacagagtgaccatcacatgcaagagcagccagagcctgctgtacagaagcaaccagaagaactacctggcctggtatcagcagaagcccggcaaggctcctaagctgctgatctactgggccagcaccagagaaagcggcgtgccaagcagattttccggcagcggctctggaaccgacttcaccctgacaatatccagcctccagcctgaggacttcgccacctactactgccagcagtattacaactaccccagaaccttcggacagggcaccaaggtggaaatcaagagaacagtggccgcc

SEQ ID NO: 371 - DNA, 741 bp, Artificial Sequence
  Synthetic Polynucleotide
gacatcgtgatgacccagacacctctgagcctgagcgtgacacctggacagcctgccagcatcagctgcaagtctagccagagcctgctggactccgacggcaagacctacctgaactggtatctccagaagccaggccagcctcctcagctgctgatctacctggtgtccaagctggatagcggcgtgcccgatagattttctggctctggcagcggcaccgacttcaccctgaagattagcagagtggaagccgaggacgtgggcatctactactgtatgcagggcacccactttccacagaccttcggccagggcaccaaggtggaaatcaagagaacagtggctgccggcggaggcggaagtggaggcggaggatctggcggcggaggctctcaagttcagctggttcagtctggggccgaagtgaagaaacctggggcctctgtgaaggtgtcctgcaaggcttccggctacacctttaccacctactacatgaactgggtccgacaggctccaggccagggacttgaatggatgggcatgatcgaccccagcgacagcgagacacactacaaccagaaattccagggcagagtgaccatgaccgccgacaccagcacaagcaccgcctacatggatctgcggagcctgagatccgatgacaccgccgtgtactactgcgccagaagtctggccttttggggccagggaaccaccgtgacagtgtctagtgcttcc

SEQ ID NO: 372 - DNA, 765 bp, Artificial Sequence
  Synthetic Polynucleotide
cagtctgtgctgacacagcctccatctgcctctggcacacctggacagagagtgtccatcagctgtagcggcagcagcagcaacatcggcagcaacaccgtgaactggtatcagcagctgcctggcacagcccctaaactgctgatctacagcaacaaccagcggcctagcggcgtgcccgatagattcagcgatagcaagagcggcacaagcgccagcctggctatttctggactccagtctgaggacgaggccgactactattgtgccgcctgggacgatagcctgaacggcccttatgtgttcggcaccggcaccagagtgacagtgctgggaacagttgcagctggcggaggcggaagtggaggcggaggatctggcggcggaggctctgaagtgcagctggttgaatcaggtggcggcctggttcaacctggcggatctctgagactgtcttgcgccgcctctggcttcaccctgaacagcagagatatgcactgggtccgacaggcccctggcaaaggacttgaatgggtgtccgccatcagcattgccggcgacacctactatcctctgtctgtgcggggcagattcaccatcagcagagacaacgccaagaacagcctgtacctccagatgaactccctgagagccgaggacaccgccgtgtactactgtgctaggggcagacacttcgacggctacaagagcgtgttcttcgactcttggggccagggcacaaccgtgacagtgtctagtgcttcc

SEQ ID NO: 373 - DNA, 750 bp, Artificial Sequence
  Synthetic Polynucleotide
gttatctggatgacacagagccccagcagcgtgtccgcttctgtgggagataccgtgaccatcacctgtagagccagccagggcatcagaagttggctggcctggtatcagcagaagcctggcaaggcccctaagctgctgatctacggcgcttcttctctgcactctggcgtgcccagcagattttctggcagcggctctggcacctacttcaccctgacaatatccagcctccagcctgaggactttgccacctactattgccagcaggccgacagctttcctccttggacatttggacagggcaccaaggtggaaatcaagaccgtggctgctggcggaggcggaagtggaggcggaggatctggcggcggaggctctgaagtgcagctggttcagtctggggccgaagtgaagagaagcggagcctctgtgaaggtgtcctgcaagctgagcggcgacacactgaccgatctgagcatccactgggtccgacaggcccctggaaaaggactggaatggatgggcggcttcgacttcgaggatggcgagatcgtgtacggcgacaagttcaagggcagagtgaccgtgacagaggaccccagcacagacaccgcctacatggacctgaagcggctgacctttgaggacaccgccatctactactgcgccaccatcaaggacatccctggccggtactacttcgatttctggggccagggcaccctggtcacagtgtcatctgcatct

SEQ ID NO: 374 - DNA, 744 bp, Artificial Sequence
  Synthetic Polynucleotide
gacatccagatgacacagagccctagcagcctgtctgccagcgtgggagacagagtgaccatcacatgtagcgccagccaggacatcggcaactttctgaactggtatcagcagaagcccggcaaggcccctaagctgctgatctactacacctccagcctgtacagcggcgtgcccagcagattttctggcagcggctctggcaccgacttcaccctgacaatatccagcctccagccagaggacttcgccacctactactgccagcagtacagcaagctgcccctgacctttggacagggcaccaagctggaaatcaagagaacagtggctgccggcggaggcggaagtggaggcggaggatctggcggcggaggctctcaagttcagctggttcagtctggggccgaagtgaagaaacctggggcctctgtgaaggtgtcctgcaaggcttccggctacacctttaccggctacaacatccactgggtccgacaggctcccggccaaagacttgaatggatgggcgctatctaccccggcaacggcgataccagctacaagcagaaattccggggcagagtgacaattaccagagacaccagcgccagcaccgcctacatggaactgtctagcctgagaagcgaggacaccgccgtgtactattgcgccagaggcgaaacagccagagccacctttgcctattggggccagggaaccctggtcacagtgtctagtgcttcc

SEQ ID NO: 375 - DNA, 750 bp, Artificial Sequence
  Synthetic Polynucleotide
gacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctggcggaggcggatcaggtggcggaggatctggcggtggtggatctcaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttct

SEQ ID NO: 376 - skipped

SEQ ID NO: 377 - DNA, 2655 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 378 - DNA, 2865 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 379 - DNA, 2700 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagggcggaggcggaagtggaggcggaggatctggcggcggaggctctgaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 380 - DNA, 2919 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagggcggaggcggaagtggaggcggaggatctggcggcggaggctctgaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 381 - DNA, 2703 bp, Artificial Sequence
  Synthetic Polynucleotide
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagggcggaggcggaagtggaggcggaggatctggcggcggaggctctgaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 382 - DNA, 2655 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 383 - DNA, 2565 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 384 - DNA, 2811 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 385 - DNA, 2865 bp, Artificial Sequence
  Synthetic Polynucleotide
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagggcggaggcggaagtggaggcggaggatctggcggcggaggctctgaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 386 - DNA, 2676 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 387 - DNA, 2721 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagggcggaggcggaagtggaggcggaggatctggcggcggaggctctgaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 388 - DNA, 2691 bp, Artificial Sequence
  Synthetic Polynucleotide
atggccttaccagtgaccgccttgctcctgccgctggccttgctgctccacgccgccaggccgctcgaggggtctggaggcggaggcagcggcggaggcgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagcatggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagggcggaggcggaagtggaggcggaggatctggcggcggaggctctgaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtggcagcggcggaggcggaagtggaggcggaggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 389 - DNA, 1929 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagggcggaggcggaagtggaggcggaggatctggcggcggaggctctgaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 390 - DNA, 2025 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagggcggaggcggaagtggaggcggaggatctggcggcggaggctctgaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 391 - DNA, 2175 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagggcggaggcggaagtggaggcggaggatctggcggcggaggctctgaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 392 - DNA, 1671 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 393 - DNA, 981 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 394 - DNA, 1389 bp, Artificial Sequence
  Synthetic Polynucleotide
atggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 395 - DNA, 891 bp, Artificial Sequence
  Synthetic Polynucleotide
atggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 396 - DNA, 1509 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagggcggaggcggaagtggaggcggaggatctggcggcggaggctctgaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 397 - DNA, 1509 bp, Artificial Sequence
  Synthetic Polynucleotide
atggccttaccagtgaccgccttgctcctgccgctggccttgctgctccacgccgccaggccggaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcggcggaggcggaagtggaggcggaggatctggcggcggaggctctgatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 398 - DNA, 2748 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagggcggaggcggaagtggaggcggaggatctggcggcggaggctctgaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 399 - DNA, 2568 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 400 - DNA, 2610 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagctcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 401 - DNA, 2607 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagctcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 402 - DNA, 2595 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagctcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 403 - DNA, 2658 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 404 - DNA, 2646 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagctcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 405 - DNA, 2565 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 406 - DNA, 2787 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 407 - DNA, 2451 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 408 - DNA, 2451 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 409 - DNA, 2664 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 410 - DNA, 2787 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaggagtaagaggagcaggctcctgcacagtgactacatgaacatgactccacgccgccccggacccacccgcaagcattaccagccctatgccccaccacgcgacttcgcagcctatcgctccagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 411 - DNA, 2670 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 412 - DNA, 2796 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 413 - DNA, 2787 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 414 - DNA, 3441 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagggcggaggcggaagtggaggcggaggatctggcggcggaggctctgaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 415 - DNA, 3405 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagggcggaggcggaagtggaggcggaggatctggcggcggaggctctgaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 416 - DNA, 3300 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagggcggaggcggaagtggaggcggaggatctggcggcggaggctctgaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 417 - DNA, 3330 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagggcggaggcggaagtggaggcggaggatctggcggcggaggctctgaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 418 - DNA, 3279 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagggcggaggcggaagtggaggcggaggatctggcggcggaggctctgaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 419 - DNA, 3387 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 420 - DNA, 3237 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 421 - DNA, 3405 bp, Artificial Sequence
  Synthetic Polynucleotide
atggccttaccagtgaccgccttgctcctgccgctggccttgctgctccacgccgccaggccggaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcggcggaggcggaagtggaggcggaggatctggcggcggaggctctgatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 422 - DNA, 3300 bp, Artificial Sequence
  Synthetic Polynucleotide
atggccttaccagtgaccgccttgctcctgccgctggccttgctgctccacgccgccaggccggaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcggcggaggcggaagtggaggcggaggatctggcggcggaggctctgatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 423 - DNA, 3330 bp, Artificial Sequence
  Synthetic Polynucleotide
atggccttaccagtgaccgccttgctcctgccgctggccttgctgctccacgccgccaggccggaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcggcggaggcggaagtggaggcggaggatctggcggcggaggctctgatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 424 - DNA, 3279 bp, Artificial Sequence
  Synthetic Polynucleotide
atggccttaccagtgaccgccttgctcctgccgctggccttgctgctccacgccgccaggccggaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcggcggaggcggaagtggaggcggaggatctggcggcggaggctctgatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 425 - DNA, 2469 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagacagagtgaccatcacctgtagagccaaccagggcatcagcaacaacctgaactggtatcagcagaagcccggcaaggcccctaagcctctgatctactacaccagcaacctccagagcggcgtgcccagcagattttctggctctggcagcggcaccgactacaccctgacaatatctagcctccagcctgaggacttcgccacctactactgccagcagttcaccagcctgccttacacctttggccaggggaccaagctggaaatcaagctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggcggaggactggttcagcctggcggatctctgagactgtcttgtgccgccagcggcttcaccttcagcaacttcgatatggcctgggtccgacaggcccctggaaaaggacttgtgtgggtgtccagcatcaccaccggcggaggcgatacctactacgccgattctgtgaagggcagattcaccatcagccgggacaacgccaagagcaccctgtacctccagatggacagcctgagaagcgaggacaccgccgtgtactattgtgtgcggcacggctactacgacggctaccacctgtttgactattggggccagggcaccctggtcacagtttctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 426 - DNA, 2655 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 427 - DNA, 2865 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 428 - DNA, 2700 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 429 - DNA, 2919 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 430 - DNA, 2703 bp, Artificial Sequence
  Synthetic Polynucleotide
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 431 - DNA, 2655 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 432 - DNA, 2565 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 433 - DNA, 2811 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 434 - DNA, 2865 bp, Artificial Sequence
  Synthetic Polynucleotide
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 435 - DNA, 2676 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 436 - DNA, 2721 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 437 - DNA, 2691 bp, Artificial Sequence
  Synthetic Polynucleotide
atggccttaccagtgaccgccttgctcctgccgctggccttgctgctccacgccgccaggccgctcgaggggtctggaggcggaggcagcggcggaggcgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagcatggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtggcagcggcggaggcggaagtggaggcggaggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 438 - DNA, 1929 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 439 - DNA, 2025 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 440 - DNA, 2175 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 441 - DNA, 1671 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 442 - DNA, 981 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 443 - DNA, 1389 bp, Artificial Sequence
  Synthetic Polynucleotide
atggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 444 - DNA, 891 bp, Artificial Sequence
  Synthetic Polynucleotide
atggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 445 - DNA, 1509 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 446 - DNA, 1509 bp, Artificial Sequence
  Synthetic Polynucleotide
atggccttaccagtgaccgccttgctcctgccgctggccttgctgctccacgccgccaggccgcaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcggcggaggcggaagtggaggcggaggatctggcggcggaggctctgatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 447 - DNA, 2748 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 448 - DNA, 2568 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 449 - DNA, 2610 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagctcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 450 - DNA, 2607 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagctcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 451 - DNA, 2595 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagctcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 452 - DNA, 2658 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 453 - DNA, 2646 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagctcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 454 - DNA, 2565 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 455 - DNA, 2787 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 456 - DNA, 2451 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 457 - DNA, 2451 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 458 - DNA, 2664 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 459 - DNA, 2787 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaggagtaagaggagcaggctcctgcacagtgactacatgaacatgactccacgccgccccggacccacccgcaagcattaccagccctatgccccaccacgcgacttcgcagcctatcgctccagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 460 - DNA, 2670 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 461 - DNA, 2796 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 462 - DNA, 2787 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 463 - DNA, 3441 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 464 - DNA, 3405 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 465 - DNA, 3300 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 466 - DNA, 3330 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 467 - DNA, 3279 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 468 - DNA, 3387 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 469 - DNA, 3237 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 470 - DNA, 3405 bp, Artificial Sequence
  Synthetic Polynucleotide
atggccttaccagtgaccgccttgctcctgccgctggccttgctgctccacgccgccaggccgcaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcggcggaggcggaagtggaggcggaggatctggcggcggaggctctgatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 471 - DNA, 3300 bp, Artificial Sequence
  Synthetic Polynucleotide
atggccttaccagtgaccgccttgctcctgccgctggccttgctgctccacgccgccaggccgcaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcggcggaggcggaagtggaggcggaggatctggcggcggaggctctgatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 472 - DNA, 3330 bp, Artificial Sequence
  Synthetic Polynucleotide
atggccttaccagtgaccgccttgctcctgccgctggccttgctgctccacgccgccaggccgcaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcggcggaggcggaagtggaggcggaggatctggcggcggaggctctgatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 473 - DNA, 3279 bp, Artificial Sequence
  Synthetic Polynucleotide
atggccttaccagtgaccgccttgctcctgccgctggccttgctgctccacgccgccaggccgcaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcggcggaggcggaagtggaggcggaggatctggcggcggaggctctgatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 474 - DNA, 2469 bp, Artificial Sequence
  Synthetic Polynucleotide
atggccttaccagtgaccgccttgctcctgccgctggccttgctgctccacgccgccaggccggatattcagatgacacagagcccctccagcctgtctgcctctgtgggagacagagtgaccatcacctgtcaggccagccaggacatcagcaactacctgaactggtatcagcagaagcccggcaaggcccctaagctgctgatctactacaccagcagactgcacaccggcgtgcccagcagattttctggctctggcagcggcaccgacttcaccttcaccataagcagcttggagcccgaggacattgccacctactactgccagcagggcaacaccctgccttggacatttggctgcggcaccaagctggaaatcaagctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggcttccggctacacctttaccaaccacatcatccactgggtccgacaggcccctggacagtgtcttgagtggatgggctacatcaacccctatcctggctaccacgcctacaacgagaagttccagggcagagccaccatgaccagcgataccagcaccagcaccgtgtacatggaactgagcagcctgagaagcgaggacaccgccgtgtactactgtgccagagatggctactaccgggacaccgacgtgctggattattggggccagggcacactggtcacagtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 475 - DNA, 2664 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 476 - DNA, 2874 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 477 - DNA, 2709 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 478 - DNA, 2928 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 479 - DNA, 2712 bp, Artificial Sequence
  Synthetic Polynucleotide
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 480 - DNA, 2664 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 481 - DNA, 2574 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 482 - DNA, 2820 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 483 - DNA, 2874 bp, Artificial Sequence
  Synthetic Polynucleotide
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 484 - DNA, 2685 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 485 - DNA, 2730 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 486 - DNA, 2700 bp, Artificial Sequence
  Synthetic Polynucleotide
atggccttaccagtgaccgccttgctcctgccgctggccttgctgctccacgccgccaggccgctcgaggggtctggaggcggaggcagcggcggaggcgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagcatggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtggcagcggcggaggcggaagtggaggcggaggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 487 - DNA, 1938 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 488 - DNA, 2034 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 489 - DNA, 2184 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 490 - DNA, 1686 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 491 - DNA, 996 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 492 - DNA, 1383 bp, Artificial Sequence
  Synthetic Polynucleotide
atggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 493 - DNA, 885 bp, Artificial Sequence
  Synthetic Polynucleotide
atggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 494 - DNA, 1518 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 495 - DNA, 1518 bp, Artificial Sequence
  Synthetic Polynucleotide
atggccttaccagtgaccgccttgctcctgccgctggccttgctgctccacgccgccaggccgcaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcggcggaggcggaagtggaggcggaggatctggcggcggaggctctgatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 496 - DNA, 2757 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 497 - DNA, 2577 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 498 - DNA, 2619 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagctcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 499 - DNA, 2616 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagctcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 500 - DNA, 2604 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagctcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 501 - DNA, 2667 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 502 - DNA, 2655 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagctcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 503 - DNA, 2574 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 504 - DNA, 2796 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 505 - DNA, 2460 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 506 - DNA, 2460 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 507 - DNA, 2673 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 508 - DNA, 2796 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaggagtaagaggagcaggctcctgcacagtgactacatgaacatgactccacgccgccccggacccacccgcaagcattaccagccctatgccccaccacgcgacttcgcagcctatcgctccagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 509 - DNA, 2679 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 510 - DNA, 2805 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 511 - DNA, 2796 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 512 - DNA, 3450 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 513 - DNA, 3414 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 514 - DNA, 3309 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 515 - DNA, 3339 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 516 - DNA, 3288 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagggcggaggcggaagtggaggcggaggatctggcggcggaggctctcaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 517 - DNA, 3396 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 518 - DNA, 3246 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 519 - DNA, 3414 bp, Artificial Sequence
  Synthetic Polynucleotide
atggccttaccagtgaccgccttgctcctgccgctggccttgctgctccacgccgccaggccgcaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcggcggaggcggaagtggaggcggaggatctggcggcggaggctctgatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 520 - DNA, 3309 bp, Artificial Sequence
  Synthetic Polynucleotide
atggccttaccagtgaccgccttgctcctgccgctggccttgctgctccacgccgccaggccgcaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcggcggaggcggaagtggaggcggaggatctggcggcggaggctctgatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 521 - DNA, 3339 bp, Artificial Sequence
  Synthetic Polynucleotide
atggccttaccagtgaccgccttgctcctgccgctggccttgctgctccacgccgccaggccgcaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcggcggaggcggaagtggaggcggaggatctggcggcggaggctctgatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 522 - DNA, 3288 bp, Artificial Sequence
  Synthetic Polynucleotide
atggccttaccagtgaccgccttgctcctgccgctggccttgctgctccacgccgccaggccgcaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcggcggaggcggaagtggaggcggaggatctggcggcggaggctctgatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 523 - DNA, 2478 bp, Artificial Sequence
  Synthetic Polynucleotide
atggccttaccagtgaccgccttgctcctgccgctggccttgctgctccacgccgccaggccggatattgtgatgacccagacacctctgagcctgagcgtgacacctggacagcctgccagcatcagctgcaagtctagccagagcctggtgcacagcaacggcaacacatacctgcactggtatctccagaagcctggacagagccctcagctgctgatctacaaggtgtccaacagattcagcggcgtgcccgacagattttctggcagcggctctggcaccgacttcaccctgaagattagcagagtggaagccgaggacgtgggcatctactactgtagccagtccagcatctacccctggacctttggacagggcaccaagctggaaatcaagctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggggcctctgtgaaggtgtcctgcaaggccagcggctacagcttccccgactactacatcaactgggtccgacaggcccctggacagggacttgaatggatgggctggatctacttcgccagcggcaactccgagtacaaccagaaattcaccggcagagtgaccatgaccagagacaccagcatcaacaccgcctacatggaactgagcagcctgaccagcgaggataccgccgtgtacttttgcgccagcctgtacgactacgactggtacttcgatgtgtggggccagggcacaatggtcacagtttctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 524 - DNA, 2655 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 525 - DNA, 2865 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 526 - DNA, 2700 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagggcggaggcggaagtggaggcggaggatctggcggcggaggctctcagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 527 - DNA, 2919 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagggcggaggcggaagtggaggcggaggatctggcggcggaggctctcagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 528 - DNA, 2703 bp, Artificial Sequence
  Synthetic Polynucleotide
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagggcggaggcggaagtggaggcggaggatctggcggcggaggctctcagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 529 - DNA, 2655 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 530 - DNA, 2565 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 531 - DNA, 2811 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 532 - DNA, 2865 bp, Artificial Sequence
  Synthetic Polynucleotide
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagggcggaggcggaagtggaggcggaggatctggcggcggaggctctcagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 533 - DNA, 2676 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 534 - DNA, 2721 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagggcggaggcggaagtggaggcggaggatctggcggcggaggctctcagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 535 - DNA, 2691 bp, Artificial Sequence
  Synthetic Polynucleotide
atggccttaccagtgaccgccttgctcctgccgctggccttgctgctccacgccgccaggccgctcgaggggtctggaggcggaggcagcggcggaggcgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagcatggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagggcggaggcggaagtggaggcggaggatctggcggcggaggctctcagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtggcagcggcggaggcggaagtggaggcggaggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 536 - DNA, 1929 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagggcggaggcggaagtggaggcggaggatctggcggcggaggctctcagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 537 - DNA, 2025 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagggcggaggcggaagtggaggcggaggatctggcggcggaggctctcagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 538 - DNA, 2175 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagggcggaggcggaagtggaggcggaggatctggcggcggaggctctcagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 539 - DNA, 1683 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 540 - DNA, 993 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 541 - DNA, 1377 bp, Artificial Sequence
  Synthetic Polynucleotide
atggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 542 - DNA, 879 bp, Artificial Sequence
  Synthetic Polynucleotide
atggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 543 - DNA, 1509 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagggcggaggcggaagtggaggcggaggatctggcggcggaggctctcagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 544 - DNA, 1509 bp, Artificial Sequence
  Synthetic Polynucleotide
atggccttaccagtgaccgccttgctcctgccgctggccttgctgctccacgccgccaggccgcagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctggcggaggcggaagtggaggcggaggatctggcggcggaggctctgacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 545 - DNA, 2748 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagggcggaggcggaagtggaggcggaggatctggcggcggaggctctcagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 546 - DNA, 2568 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 547 - DNA, 2610 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagctcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 548 - DNA, 2607 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagctcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 549 - DNA, 2595 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagctcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 550 - DNA, 2658 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 551 - DNA, 2646 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagctcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 552 - DNA, 2565 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 553 - DNA, 2787 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 554 - DNA, 2451 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 555 - DNA, 2451 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 556 - DNA, 2664 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 557 - DNA, 2787 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaggagtaagaggagcaggctcctgcacagtgactacatgaacatgactccacgccgccccggacccacccgcaagcattaccagccctatgccccaccacgcgacttcgcagcctatcgctccagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 558 - DNA, 2670 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 559 - DNA, 2796 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 560 - DNA, 2787 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 561 - DNA, 3441 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagggcggaggcggaagtggaggcggaggatctggcggcggaggctctcagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 562 - DNA, 3405 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagggcggaggcggaagtggaggcggaggatctggcggcggaggctctcagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 563 - DNA, 3300 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagggcggaggcggaagtggaggcggaggatctggcggcggaggctctcagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 564 - DNA, 3330 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagggcggaggcggaagtggaggcggaggatctggcggcggaggctctcagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 565 - DNA, 3279 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagggcggaggcggaagtggaggcggaggatctggcggcggaggctctcagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 566 - DNA, 3387 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 567 - DNA, 3237 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 568 - DNA, 3405 bp, Artificial Sequence
  Synthetic Polynucleotide
atggccttaccagtgaccgccttgctcctgccgctggccttgctgctccacgccgccaggccgcagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctggcggaggcggaagtggaggcggaggatctggcggcggaggctctgacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 569 - DNA, 3300 bp, Artificial Sequence
  Synthetic Polynucleotide
atggccttaccagtgaccgccttgctcctgccgctggccttgctgctccacgccgccaggccgcagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctggcggaggcggaagtggaggcggaggatctggcggcggaggctctgacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 570 - DNA, 3330 bp, Artificial Sequence
  Synthetic Polynucleotide
atggccttaccagtgaccgccttgctcctgccgctggccttgctgctccacgccgccaggccgcagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctggcggaggcggaagtggaggcggaggatctggcggcggaggctctgacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 571 - DNA, 3279 bp, Artificial Sequence
  Synthetic Polynucleotide
atggccttaccagtgaccgccttgctcctgccgctggccttgctgctccacgccgccaggccgcagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctggcggaggcggaagtggaggcggaggatctggcggcggaggctctgacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 572 - DNA, 2469 bp, Artificial Sequence
  Synthetic Polynucleotide
atggccttaccagtgaccgccttgctcctgccgctggccttgctgctccacgccgccaggccggacatcgtgctgacacagagccctccaagcctggctatgagcctgggaaagagagccaccatcagctgtagagccagcgagagcgtgacaatcctgggctctcacctgatccactggtatcagcagaagcccggccagcctcctacactgctgattcagctggcctccaatgtgcagacaggcgtgccagccagattttctggcagcggcagcagaaccgacttcaccctgaccattgatcccgtggaagaggacgacgtggccgtgtactactgcctccagagcagaacaatccccagaacctttggcggaggcaccaagctggaaatcaagctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacagatccagctggtgcagtctggccccgagctgaagaaacctggcgagacagtgaagatcagctgcaaggccagcggctacaccttcaccgactacagcatcaactgggtcaagagagcccctggcaagggcctgaaatggatgggctggatcaacaccgaaaccagagagcccgcctacgcctacgacttcagaggcagattcgccttcagcctggaaaccagcgccagcacagcctacctccagatcaacaacctgaagtacgaggacaccgccacctacttttgcgccctggactacagctacgctatggactattggggccagggcaccagcgtgacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 573 - DNA, 2673 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 574 - DNA, 2883 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 575 - DNA, 2718 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccggcggaggcggaagtggaggcggaggatctggcggcggaggctctgaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 576 - DNA, 2937 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccggcggaggcggaagtggaggcggaggatctggcggcggaggctctgaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 577 - DNA, 2721 bp, Artificial Sequence
  Synthetic Polynucleotide
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccggcggaggcggaagtggaggcggaggatctggcggcggaggctctgaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 578 - DNA, 2673 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 579 - DNA, 2583 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 580 - DNA, 2829 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 581 - DNA, 2883 bp, Artificial Sequence
  Synthetic Polynucleotide
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccggcggaggcggaagtggaggcggaggatctggcggcggaggctctgaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 582 - DNA, 2694 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 583 - DNA, 2739 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccggcggaggcggaagtggaggcggaggatctggcggcggaggctctgaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 584 - DNA, 2709 bp, Artificial Sequence
  Synthetic Polynucleotide
atggccttaccagtgaccgccttgctcctgccgctggccttgctgctccacgccgccaggccgctcgaggggtctggaggcggaggcagcggcggaggcgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagcatggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccggcggaggcggaagtggaggcggaggatctggcggcggaggctctgaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtggcagcggcggaggcggaagtggaggcggaggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 585 - DNA, 1947 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccggcggaggcggaagtggaggcggaggatctggcggcggaggctctgaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 586 - DNA, 2043 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccggcggaggcggaagtggaggcggaggatctggcggcggaggctctgaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 587 - DNA, 2193 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccggcggaggcggaagtggaggcggaggatctggcggcggaggctctgaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 588 - DNA, 1701 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 589 - DNA, 1011 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 590 - DNA, 1377 bp, Artificial Sequence
  Synthetic Polynucleotide
atggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 591 - DNA, 879 bp, Artificial Sequence
  Synthetic Polynucleotide
atggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 592 - DNA, 1527 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccggcggaggcggaagtggaggcggaggatctggcggcggaggctctgaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 593 - DNA, 1527 bp, Artificial Sequence
  Synthetic Polynucleotide
atggccttaccagtgaccgccttgctcctgccgctggccttgctgctccacgccgccaggccggaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcggcggaggcggaagtggaggcggaggatctggcggcggaggctctgacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 594 - DNA, 2766 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccggcggaggcggaagtggaggcggaggatctggcggcggaggctctgaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 595 - DNA, 2586 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 596 - DNA, 2628 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccctcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 597 - DNA, 2625 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccctcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 598 - DNA, 2613 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccctcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 599 - DNA, 2676 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 600 - DNA, 2664 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccctcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 601 - DNA, 2583 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 602 - DNA, 2805 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 603 - DNA, 2469 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 604 - DNA, 2469 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 605 - DNA, 2682 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 606 - DNA, 2805 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaggagtaagaggagcaggctcctgcacagtgactacatgaacatgactccacgccgccccggacccacccgcaagcattaccagccctatgccccaccacgcgacttcgcagcctatcgctccagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 607 - DNA, 2688 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 608 - DNA, 2814 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 609 - DNA, 2805 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 610 - DNA, 3459 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccggcggaggcggaagtggaggcggaggatctggcggcggaggctctgaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 611 - DNA, 3423 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccggcggaggcggaagtggaggcggaggatctggcggcggaggctctgaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 612 - DNA, 3318 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccggcggaggcggaagtggaggcggaggatctggcggcggaggctctgaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 613 - DNA, 3348 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccggcggaggcggaagtggaggcggaggatctggcggcggaggctctgaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 614 - DNA, 3297 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccggcggaggcggaagtggaggcggaggatctggcggcggaggctctgaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 615 - DNA, 3405 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 616 - DNA, 3255 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 617 - DNA, 3423 bp, Artificial Sequence
  Synthetic Polynucleotide
atggccttaccagtgaccgccttgctcctgccgctggccttgctgctccacgccgccaggccggaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcggcggaggcggaagtggaggcggaggatctggcggcggaggctctgacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 618 - DNA, 3318 bp, Artificial Sequence
  Synthetic Polynucleotide
atggccttaccagtgaccgccttgctcctgccgctggccttgctgctccacgccgccaggccggaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcggcggaggcggaagtggaggcggaggatctggcggcggaggctctgacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 619 - DNA, 3348 bp, Artificial Sequence
  Synthetic Polynucleotide
atggccttaccagtgaccgccttgctcctgccgctggccttgctgctccacgccgccaggccggaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcggcggaggcggaagtggaggcggaggatctggcggcggaggctctgacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 620 - DNA, 3297 bp, Artificial Sequence
  Synthetic Polynucleotide
atggccttaccagtgaccgccttgctcctgccgctggccttgctgctccacgccgccaggccggaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcggcggaggcggaagtggaggcggaggatctggcggcggaggctctgacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 621 - DNA, 2487 bp, Artificial Sequence
  Synthetic Polynucleotide
atggccttaccagtgaccgccttgctcctgccgctggccttgctgctccacgccgccaggccggacgtggtcatgacacagacccctctgagcctgcctgtgacacctggcgaacctgccagcatcagctgtagaagcagccagagcctggtgcacagcaccggcaatacctacctgcactggtatctccagaagcctggacagagccccaagctgctgatctacaaggtgtccaacagattcagcggcgtgcccgacagattttctggcagcggctctggcaccgacttcaccctgaagattagcagagtggaagccgaggacgtgggcgtgtacttctgtagccagagcacccacgtgccattcacattcggccagggcaccaagctggaaatcaagagaacagtggctgccctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctggttcagtctggggccgaagtgaagaagccaggcgagagcctgaaaatcagctgccaggctttcggctacaccttcaccagctactggatgcagtggatcagacagatgccaggccagggcctcgaatggatcggcgagattgaccccagcgacaacaccctgtacaaccagaagttcaaaggccaggccacactgagcgccgacaagtctagcagcacagcctacctccagtggtcctctctgaaggccagcgacaccgccatgtacttttgcgccagattcggctactacgtggactactggggccagggaacaatggtcacagtgtctagcgccagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 622 - DNA, 2685 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 623 - DNA, 2895 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 624 - DNA, 2730 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccggcggaggcggaagtggaggcggaggatctggcggcggaggctctcaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 625 - DNA, 2949 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccggcggaggcggaagtggaggcggaggatctggcggcggaggctctcaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 626 - DNA, 2733 bp, Artificial Sequence
  Synthetic Polynucleotide
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccggcggaggcggaagtggaggcggaggatctggcggcggaggctctcaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 627 - DNA, 2685 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 628 - DNA, 2595 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 629 - DNA, 2841 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 630 - DNA, 2895 bp, Artificial Sequence
  Synthetic Polynucleotide
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccggcggaggcggaagtggaggcggaggatctggcggcggaggctctcaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 631 - DNA, 2706 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 632 - DNA, 2751 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccggcggaggcggaagtggaggcggaggatctggcggcggaggctctcaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 633 - DNA, 2721 bp, Artificial Sequence
  Synthetic Polynucleotide
atggccttaccagtgaccgccttgctcctgccgctggccttgctgctccacgccgccaggccgctcgaggggtctggaggcggaggcagcggcggaggcgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagcatggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccggcggaggcggaagtggaggcggaggatctggcggcggaggctctcaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtggcagcggcggaggcggaagtggaggcggaggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 634 - DNA, 1959 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccggcggaggcggaagtggaggcggaggatctggcggcggaggctctcaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 635 - DNA, 2055 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccggcggaggcggaagtggaggcggaggatctggcggcggaggctctcaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 636 - DNA, 2205 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccggcggaggcggaagtggaggcggaggatctggcggcggaggctctcaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 637 - DNA, 1686 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 638 - DNA, 996 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 639 - DNA, 1404 bp, Artificial Sequence
  Synthetic Polynucleotide
atggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 640 - DNA, 906 bp, Artificial Sequence
  Synthetic Polynucleotide
atggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 641 - DNA, 1539 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccggcggaggcggaagtggaggcggaggatctggcggcggaggctctcaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 642 - DNA, 1539 bp, Artificial Sequence
  Synthetic Polynucleotide
atggccttaccagtgaccgccttgctcctgccgctggccttgctgctccacgccgccaggccgcaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccggcggaggcggaagtggaggcggaggatctggcggcggaggctctgacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 643 - DNA, 2778 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccggcggaggcggaagtggaggcggaggatctggcggcggaggctctcaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 644 - DNA, 2598 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 645 - DNA, 2640 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccctcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 646 - DNA, 2637 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccctcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 647 - DNA, 2625 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccctcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 648 - DNA, 2688 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 649 - DNA, 2676 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccctcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 650 - DNA, 2595 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 651 - DNA, 2817 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 652 - DNA, 2481 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 653 - DNA, 2481 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 654 - DNA, 2694 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 655 - DNA, 2817 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaggagtaagaggagcaggctcctgcacagtgactacatgaacatgactccacgccgccccggacccacccgcaagcattaccagccctatgccccaccacgcgacttcgcagcctatcgctccagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 656 - DNA, 2700 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 657 - DNA, 2826 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 658 - DNA, 2817 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 659 - DNA, 3471 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccggcggaggcggaagtggaggcggaggatctggcggcggaggctctcaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 660 - DNA, 3435 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccggcggaggcggaagtggaggcggaggatctggcggcggaggctctcaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 661 - DNA, 3330 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccggcggaggcggaagtggaggcggaggatctggcggcggaggctctcaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 662 - DNA, 3360 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccggcggaggcggaagtggaggcggaggatctggcggcggaggctctcaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 663 - DNA, 3309 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccggcggaggcggaagtggaggcggaggatctggcggcggaggctctcaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 664 - DNA, 3417 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 665 - DNA, 3267 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 666 - DNA, 3435 bp, Artificial Sequence
  Synthetic Polynucleotide
atggccttaccagtgaccgccttgctcctgccgctggccttgctgctccacgccgccaggccgcaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccggcggaggcggaagtggaggcggaggatctggcggcggaggctctgacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 667 - DNA, 3330 bp, Artificial Sequence
  Synthetic Polynucleotide
atggccttaccagtgaccgccttgctcctgccgctggccttgctgctccacgccgccaggccgcaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccggcggaggcggaagtggaggcggaggatctggcggcggaggctctgacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 668 - DNA, 3360 bp, Artificial Sequence
  Synthetic Polynucleotide
atggccttaccagtgaccgccttgctcctgccgctggccttgctgctccacgccgccaggccgcaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccggcggaggcggaagtggaggcggaggatctggcggcggaggctctgacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 669 - DNA, 3309 bp, Artificial Sequence
  Synthetic Polynucleotide
atggccttaccagtgaccgccttgctcctgccgctggccttgctgctccacgccgccaggccgcaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccggcggaggcggaagtggaggcggaggatctggcggcggaggctctgacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 670 - DNA, 2499 bp, Artificial Sequence
  Synthetic Polynucleotide
atggccttaccagtgaccgccttgctcctgccgctggccttgctgctccacgccgccaggccggacatccagatgacccagaccacaagcagcctgtctgccagcctgggcgatagagtgaccatcagctgtagagccagccaggacatcagcaactttctgaactggtatcagcagaagcccgacggcaccatcaagtttctgatctactacaccagcagactgcacagcggcgtgcccagcagattttctggctctggcagcggcaccgactacagcctgacaatcagaaacctggaacaagaggacattgccacctacttttgccagcaaggcaacaccctgccttacacctttggcggaggcaccaagctggaaatcaagagaacagtggctgccctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctgcaacaacccggcgctgagcttgtgaaacctggcgcttctgtgaagctgagctgcaaggccagcggctacaccttcatcagctactggatgcactgggtcaagcagcggcctggacaaggactggaatggatcggcatgattcaccccaacagcggcagcaccaactacaacgagagcttcaagagcaaggccacactgaccgtggacaagagcagctccacagcctacatgcagctgagcagcctgaccagcgaagatagcgccgtgtactactgcgccagggatctgctgatcgccaccgtggtggtcaccccttactttgcctattggggccagggcaccatcctgacagtgtctagtgcttccacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 671 - DNA, 2691 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 672 - DNA, 2901 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 673 - DNA, 2736 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccggcggaggcggaagtggaggcggaggatctggcggcggaggctctcaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 674 - DNA, 2955 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccggcggaggcggaagtggaggcggaggatctggcggcggaggctctcaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 675 - DNA, 2739 bp, Artificial Sequence
  Synthetic Polynucleotide
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccggcggaggcggaagtggaggcggaggatctggcggcggaggctctcaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 676 - DNA, 2691 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 677 - DNA, 2601 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 678 - DNA, 2847 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 679 - DNA, 2901 bp, Artificial Sequence
  Synthetic Polynucleotide
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccggcggaggcggaagtggaggcggaggatctggcggcggaggctctcaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 680 - DNA, 2712 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 681 - DNA, 2757 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccggcggaggcggaagtggaggcggaggatctggcggcggaggctctcaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 682 - DNA, 2727 bp, Artificial Sequence
  Synthetic Polynucleotide
atggccttaccagtgaccgccttgctcctgccgctggccttgctgctccacgccgccaggccgctcgaggggtctggaggcggaggcagcggcggaggcgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagcatggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccggcggaggcggaagtggaggcggaggatctggcggcggaggctctcaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtggcagcggcggaggcggaagtggaggcggaggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 683 - DNA, 1965 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccggcggaggcggaagtggaggcggaggatctggcggcggaggctctcaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 684 - DNA, 2061 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccggcggaggcggaagtggaggcggaggatctggcggcggaggctctcaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 685 - DNA, 2211 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccggcggaggcggaagtggaggcggaggatctggcggcggaggctctcaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 686 - DNA, 1701 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 687 - DNA, 1011 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 688 - DNA, 1395 bp, Artificial Sequence
  Synthetic Polynucleotide
atggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 689 - DNA, 897 bp, Artificial Sequence
  Synthetic Polynucleotide
atggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 690 - DNA, 1545 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccggcggaggcggaagtggaggcggaggatctggcggcggaggctctcaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 691 - DNA, 1545 bp, Artificial Sequence
  Synthetic Polynucleotide
atggccttaccagtgaccgccttgctcctgccgctggccttgctgctccacgccgccaggccgcaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccggcggaggcggaagtggaggcggaggatctggcggcggaggctctgacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 692 - DNA, 2784 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccggcggaggcggaagtggaggcggaggatctggcggcggaggctctcaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 693 - DNA, 2604 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 694 - DNA, 2646 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccctcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 695 - DNA, 2643 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccctcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 696 - DNA, 2631 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccctcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 697 - DNA, 2694 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 698 - DNA, 2682 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccctcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 699 - DNA, 2601 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 700 - DNA, 2823 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 701 - DNA, 2487 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 702 - DNA, 2487 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 703 - DNA, 2700 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 704 - DNA, 2823 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaggagtaagaggagcaggctcctgcacagtgactacatgaacatgactccacgccgccccggacccacccgcaagcattaccagccctatgccccaccacgcgacttcgcagcctatcgctccagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 705 - DNA, 2706 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 706 - DNA, 2832 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 707 - DNA, 2823 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 708 - DNA, 3477 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccggcggaggcggaagtggaggcggaggatctggcggcggaggctctcaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 709 - DNA, 3441 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccggcggaggcggaagtggaggcggaggatctggcggcggaggctctcaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 710 - DNA, 3336 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccggcggaggcggaagtggaggcggaggatctggcggcggaggctctcaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 711 - DNA, 3366 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccggcggaggcggaagtggaggcggaggatctggcggcggaggctctcaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 712 - DNA, 3315 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccggcggaggcggaagtggaggcggaggatctggcggcggaggctctcaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 713 - DNA, 3423 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 714 - DNA, 3273 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 715 - DNA, 3441 bp, Artificial Sequence
  Synthetic Polynucleotide
atggccttaccagtgaccgccttgctcctgccgctggccttgctgctccacgccgccaggccgcaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccggcggaggcggaagtggaggcggaggatctggcggcggaggctctgacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 716 - DNA, 3336 bp, Artificial Sequence
  Synthetic Polynucleotide
atggccttaccagtgaccgccttgctcctgccgctggccttgctgctccacgccgccaggccgcaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccggcggaggcggaagtggaggcggaggatctggcggcggaggctctgacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 717 - DNA, 3366 bp, Artificial Sequence
  Synthetic Polynucleotide
atggccttaccagtgaccgccttgctcctgccgctggccttgctgctccacgccgccaggccgcaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccggcggaggcggaagtggaggcggaggatctggcggcggaggctctgacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 718 - DNA, 3315 bp, Artificial Sequence
  Synthetic Polynucleotide
atggccttaccagtgaccgccttgctcctgccgctggccttgctgctccacgccgccaggccgcaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccggcggaggcggaagtggaggcggaggatctggcggcggaggctctgacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 719 - DNA, 2505 bp, Artificial Sequence
  Synthetic Polynucleotide
atggccttaccagtgaccgccttgctcctgccgctggccttgctgctccacgccgccaggccggacatcgtgatgacacagagccctgatagcctggccgtgtctctgggagagagagccaccatcaactgcaagagcagccagaacctgctgtactccaccaaccagaagaactacctggcctggtatcagcagaagcccggccagcctcctaagctgctgatctactgggccagcaccagagaaagcggcgtgcccgatagattttctggcagcggctctggcaccgacttcaccctgacaattagcagcctccaggccgaggatgtggccgtgtactactgccagcagtattacagctaccggaccttcggccagggcaccaaggtggaaatcaagagaacagtggctgccctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaagagtctggccccggactggtcaagcctagcgaaacactgagcctgacctgtaccgtgtccggctacagcatcaccagcgactacgcctggaactggatcagacagcctcctggcaaaggactggaatggatcggctacatcagctacagcggcagcatccggtacaaccccagcctgaaaagcagagtgaccatcagcgtggacaccagcaagaaccagttcagcctgaagctgagcagcgtgacagccgccgataccgccgtgtattattgcgccagagagaagtacgacaactactactacgctatggactactggggccagggaacaatggtcaccgtgtctagtgcttccacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 720 - DNA, 2673 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 721 - DNA, 2883 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 722 - DNA, 2718 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaaggcggaggcggaagtggaggcggaggatctggcggcggaggctctcaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 723 - DNA, 2937 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaaggcggaggcggaagtggaggcggaggatctggcggcggaggctctcaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 724 - DNA, 2721 bp, Artificial Sequence
  Synthetic Polynucleotide
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaaggcggaggcggaagtggaggcggaggatctggcggcggaggctctcaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 725 - DNA, 2673 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 726 - DNA, 2583 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 727 - DNA, 2829 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 728 - DNA, 2883 bp, Artificial Sequence
  Synthetic Polynucleotide
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaaggcggaggcggaagtggaggcggaggatctggcggcggaggctctcaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 729 - DNA, 2694 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 730 - DNA, 2739 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaaggcggaggcggaagtggaggcggaggatctggcggcggaggctctcaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 731 - DNA, 2709 bp, Artificial Sequence
  Synthetic Polynucleotide
atggccttaccagtgaccgccttgctcctgccgctggccttgctgctccacgccgccaggccgctcgaggggtctggaggcggaggcagcggcggaggcgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagcatggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaaggcggaggcggaagtggaggcggaggatctggcggcggaggctctcaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtggcagcggcggaggcggaagtggaggcggaggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 732 - DNA, 1947 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaaggcggaggcggaagtggaggcggaggatctggcggcggaggctctcaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 733 - DNA, 2043 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaaggcggaggcggaagtggaggcggaggatctggcggcggaggctctcaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 734 - DNA, 2193 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaaggcggaggcggaagtggaggcggaggatctggcggcggaggctctcaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 735 - DNA, 1686 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 736 - DNA, 996 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 737 - DNA, 1392 bp, Artificial Sequence
  Synthetic Polynucleotide
atggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 738 - DNA, 894 bp, Artificial Sequence
  Synthetic Polynucleotide
atggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 739 - DNA, 1527 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaaggcggaggcggaagtggaggcggaggatctggcggcggaggctctcaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 740 - DNA, 1527 bp, Artificial Sequence
  Synthetic Polynucleotide
atggccttaccagtgaccgccttgctcctgccgctggccttgctgctccacgccgccaggccgcaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctggcggaggcggaagtggaggcggaggatctggcggcggaggctctgacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 741 - DNA, 2766 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaaggcggaggcggaagtggaggcggaggatctggcggcggaggctctcaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 742 - DNA, 2586 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 743 - DNA, 2628 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 744 - DNA, 2625 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 745 - DNA, 2613 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 746 - DNA, 2676 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 747 - DNA, 2664 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaactcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 748 - DNA, 2583 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 749 - DNA, 2805 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaaggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 750 - DNA, 2469 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 751 - DNA, 2469 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 752 - DNA, 2682 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 753 - DNA, 2805 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaggagtaagaggagcaggctcctgcacagtgactacatgaacatgactccacgccgccccggacccacccgcaagcattaccagccctatgccccaccacgcgacttcgcagcctatcgctccagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 754 - DNA, 2688 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 755 - DNA, 2814 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 756 - DNA, 2805 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaaggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 757 - DNA, 3459 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaaggcggaggcggaagtggaggcggaggatctggcggcggaggctctcaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 758 - DNA, 3423 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaaggcggaggcggaagtggaggcggaggatctggcggcggaggctctcaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 759 - DNA, 3318 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaaggcggaggcggaagtggaggcggaggatctggcggcggaggctctcaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 760 - DNA, 3348 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaaggcggaggcggaagtggaggcggaggatctggcggcggaggctctcaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 761 - DNA, 3297 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaaggcggaggcggaagtggaggcggaggatctggcggcggaggctctcaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 762 - DNA, 3405 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 763 - DNA, 3255 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 764 - DNA, 3423 bp, Artificial Sequence
  Synthetic Polynucleotide
atggccttaccagtgaccgccttgctcctgccgctggccttgctgctccacgccgccaggccgcaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctggcggaggcggaagtggaggcggaggatctggcggcggaggctctgacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 765 - DNA, 3318 bp, Artificial Sequence
  Synthetic Polynucleotide
atggccttaccagtgaccgccttgctcctgccgctggccttgctgctccacgccgccaggccgcaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctggcggaggcggaagtggaggcggaggatctggcggcggaggctctgacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 766 - DNA, 3348 bp, Artificial Sequence
  Synthetic Polynucleotide
atggccttaccagtgaccgccttgctcctgccgctggccttgctgctccacgccgccaggccgcaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctggcggaggcggaagtggaggcggaggatctggcggcggaggctctgacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 767 - DNA, 3297 bp, Artificial Sequence
  Synthetic Polynucleotide
atggccttaccagtgaccgccttgctcctgccgctggccttgctgctccacgccgccaggccgcaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctggcggaggcggaagtggaggcggaggatctggcggcggaggctctgacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 768 - DNA, 2487 bp, Artificial Sequence
  Synthetic Polynucleotide
atggccttaccagtgaccgccttgctcctgccgctggccttgctgctccacgccgccaggccggacatcgtgatgacacagagccctctgagcctgcctgtgacacctggcgaacctgccagcatcagctgtagaagcagccagagcctgctgcacagcaacagattcaactacctggactggtatctccagaagcctggacagagcccacagctgctgatctacctgggcagcaatagagccagcggcgtgcccgatagattttctggctctggcagcggcaccgacttcaccctgaagattagcagagtggaagccgaggacgtgggcgtgtactactgtatgcaggccctccagacacctctgacctttgcctgtggcaccaaggtggaaatcaaactcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgcagctggttgagtcaggtggcggagttgtgcagcctggcagatccctgagactgagctgtgaagcctccggcttcatcgtgtccaactacggaatgcactgggtccgacaggcccctggcaaatgtctggaatgggttgccgccatcggctgggagggcagcaacaagtattatgccgagcctgtgaagggcagattcaccatcagccgggacaagagcaagaacaccctgagcctccagatgagcagcctgagagccgaagatacagccctgtactattgcgccagagacagaggcaccatctttggctactacggcatggacgtgtggggccagggaaccacagtgacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 769 - DNA, 2664 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 770 - DNA, 2874 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 771 - DNA, 2709 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaaggcggaggcggaagtggaggcggaggatctggcggcggaggctctgaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 772 - DNA, 2928 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaaggcggaggcggaagtggaggcggaggatctggcggcggaggctctgaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 773 - DNA, 2712 bp, Artificial Sequence
  Synthetic Polynucleotide
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaaggcggaggcggaagtggaggcggaggatctggcggcggaggctctgaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 774 - DNA, 2664 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 775 - DNA, 2574 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 776 - DNA, 2820 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 777 - DNA, 2874 bp, Artificial Sequence
  Synthetic Polynucleotide
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaaggcggaggcggaagtggaggcggaggatctggcggcggaggctctgaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 778 - DNA, 2685 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 779 - DNA, 2730 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaaggcggaggcggaagtggaggcggaggatctggcggcggaggctctgaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 780 - DNA, 2700 bp, Artificial Sequence
  Synthetic Polynucleotide
atggccttaccagtgaccgccttgctcctgccgctggccttgctgctccacgccgccaggccgctcgaggggtctggaggcggaggcagcggcggaggcgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagcatggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaaggcggaggcggaagtggaggcggaggatctggcggcggaggctctgaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtggcagcggcggaggcggaagtggaggcggaggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 781 - DNA, 1938 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaaggcggaggcggaagtggaggcggaggatctggcggcggaggctctgaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 782 - DNA, 2034 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaaggcggaggcggaagtggaggcggaggatctggcggcggaggctctgaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 783 - DNA, 2184 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaaggcggaggcggaagtggaggcggaggatctggcggcggaggctctgaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 784 - DNA, 1674 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 785 - DNA, 984 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 786 - DNA, 1395 bp, Artificial Sequence
  Synthetic Polynucleotide
atggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 787 - DNA, 897 bp, Artificial Sequence
  Synthetic Polynucleotide
atggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 788 - DNA, 1518 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaaggcggaggcggaagtggaggcggaggatctggcggcggaggctctgaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 789 - DNA, 1518 bp, Artificial Sequence
  Synthetic Polynucleotide
atggccttaccagtgaccgccttgctcctgccgctggccttgctgctccacgccgccaggccggaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctggcggaggcggaagtggaggcggaggatctggcggcggaggctctgacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 790 - DNA, 2757 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaaggcggaggcggaagtggaggcggaggatctggcggcggaggctctgaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 791 - DNA, 2577 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 792 - DNA, 2619 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 793 - DNA, 2616 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 794 - DNA, 2604 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 795 - DNA, 2667 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 796 - DNA, 2655 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaactcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 797 - DNA, 2574 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 798 - DNA, 2796 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaaggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 799 - DNA, 2460 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 800 - DNA, 2460 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 801 - DNA, 2673 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 802 - DNA, 2796 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaggagtaagaggagcaggctcctgcacagtgactacatgaacatgactccacgccgccccggacccacccgcaagcattaccagccctatgccccaccacgcgacttcgcagcctatcgctccagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 803 - DNA, 2679 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 804 - DNA, 2805 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 805 - DNA, 2796 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaaggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 806 - DNA, 3450 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaaggcggaggcggaagtggaggcggaggatctggcggcggaggctctgaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 807 - DNA, 3414 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaaggcggaggcggaagtggaggcggaggatctggcggcggaggctctgaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 808 - DNA, 3309 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaaggcggaggcggaagtggaggcggaggatctggcggcggaggctctgaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 809 - DNA, 3339 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaaggcggaggcggaagtggaggcggaggatctggcggcggaggctctgaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 810 - DNA, 3288 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaaggcggaggcggaagtggaggcggaggatctggcggcggaggctctgaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 811 - DNA, 3396 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 812 - DNA, 3246 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 813 - DNA, 3414 bp, Artificial Sequence
  Synthetic Polynucleotide
atggccttaccagtgaccgccttgctcctgccgctggccttgctgctccacgccgccaggccggaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctggcggaggcggaagtggaggcggaggatctggcggcggaggctctgacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 814 - DNA, 3309 bp, Artificial Sequence
  Synthetic Polynucleotide
atggccttaccagtgaccgccttgctcctgccgctggccttgctgctccacgccgccaggccggaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctggcggaggcggaagtggaggcggaggatctggcggcggaggctctgacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 815 - DNA, 3339 bp, Artificial Sequence
  Synthetic Polynucleotide
atggccttaccagtgaccgccttgctcctgccgctggccttgctgctccacgccgccaggccggaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctggcggaggcggaagtggaggcggaggatctggcggcggaggctctgacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 816 - DNA, 3288 bp, Artificial Sequence
  Synthetic Polynucleotide
atggccttaccagtgaccgccttgctcctgccgctggccttgctgctccacgccgccaggccggaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctggcggaggcggaagtggaggcggaggatctggcggcggaggctctgacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 817 - DNA, 2478 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccattacctgtcaggccagcgagacaatctacagcagcctggcctggtatcagcagaagcctggcaagcctcctaagctgctgatctacggggccagcaatctggaaagcggcgtgccaagcagattttccggctctggcagcggcaccgacttcaccttcacaatatccagcctccagcctgaggacattgccacctactactgtcagagcggcgtgtactctgccggcctgacatttggcggcggaacaaaggtggaaatcaaactcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaagttcagctgcttgaatcaggtggcggcctggttcaacctggcggatctctgagactgagctgtgccgccagcggcttcacctttagctcttatggcgtgtcctgggtccgacaggcccctggaaaaggactggaatggatcggctacaacgaccccgtgttcggcagcatctactacgcctcttgggtcaagggcagattcaccatcagcagcgacaacagcaagaacaccctgtacctccagatgaactccctgagagccgaggacaccgccgtgtactactgcgccaaggacagatcctacgtgtccagctccggctaccacttcaatctgtggggccagggcacactggtcaccgtttcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 818 - DNA, 2649 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 819 - DNA, 2859 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 820 - DNA, 2694 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagaggcggaggcggaagtggaggcggaggatctggcggcggaggctctcaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 821 - DNA, 2913 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagaggcggaggcggaagtggaggcggaggatctggcggcggaggctctcaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 822 - DNA, 2697 bp, Artificial Sequence
  Synthetic Polynucleotide
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagaggcggaggcggaagtggaggcggaggatctggcggcggaggctctcaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 823 - DNA, 2649 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 824 - DNA, 2559 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 825 - DNA, 2805 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 826 - DNA, 2859 bp, Artificial Sequence
  Synthetic Polynucleotide
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagaggcggaggcggaagtggaggcggaggatctggcggcggaggctctcaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 827 - DNA, 2670 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 828 - DNA, 2715 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagaggcggaggcggaagtggaggcggaggatctggcggcggaggctctcaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 829 - DNA, 2685 bp, Artificial Sequence
  Synthetic Polynucleotide
atggccttaccagtgaccgccttgctcctgccgctggccttgctgctccacgccgccaggccgctcgaggggtctggaggcggaggcagcggcggaggcgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagcatggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagaggcggaggcggaagtggaggcggaggatctggcggcggaggctctcaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtggcagcggcggaggcggaagtggaggcggaggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 830 - DNA, 1923 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagaggcggaggcggaagtggaggcggaggatctggcggcggaggctctcaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 831 - DNA, 2019 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagaggcggaggcggaagtggaggcggaggatctggcggcggaggctctcaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 832 - DNA, 2169 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagaggcggaggcggaagtggaggcggaggatctggcggcggaggctctcaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 833 - DNA, 1671 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 834 - DNA, 981 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 835 - DNA, 1383 bp, Artificial Sequence
  Synthetic Polynucleotide
atggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 836 - DNA, 885 bp, Artificial Sequence
  Synthetic Polynucleotide
atggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 837 - DNA, 1503 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagaggcggaggcggaagtggaggcggaggatctggcggcggaggctctcaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 838 - DNA, 1503 bp, Artificial Sequence
  Synthetic Polynucleotide
atggccttaccagtgaccgccttgctcctgccgctggccttgctgctccacgccgccaggccgcaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcggcggaggcggaagtggaggcggaggatctggcggcggaggctctcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 839 - DNA, 2742 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagaggcggaggcggaagtggaggcggaggatctggcggcggaggctctcaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 840 - DNA, 2562 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 841 - DNA, 2604 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 842 - DNA, 2601 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 843 - DNA, 2589 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 844 - DNA, 2652 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 845 - DNA, 2640 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagactcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 846 - DNA, 2559 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 847 - DNA, 2781 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagaggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 848 - DNA, 2445 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 849 - DNA, 2445 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 850 - DNA, 2658 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 851 - DNA, 2781 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaggagtaagaggagcaggctcctgcacagtgactacatgaacatgactccacgccgccccggacccacccgcaagcattaccagccctatgccccaccacgcgacttcgcagcctatcgctccagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 852 - DNA, 2664 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 853 - DNA, 2790 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 854 - DNA, 2781 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagaggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 855 - DNA, 3435 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagaggcggaggcggaagtggaggcggaggatctggcggcggaggctctcaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 856 - DNA, 3399 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagaggcggaggcggaagtggaggcggaggatctggcggcggaggctctcaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 857 - DNA, 3294 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagaggcggaggcggaagtggaggcggaggatctggcggcggaggctctcaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 858 - DNA, 3324 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagaggcggaggcggaagtggaggcggaggatctggcggcggaggctctcaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 859 - DNA, 3273 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagaggcggaggcggaagtggaggcggaggatctggcggcggaggctctcaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 860 - DNA, 3381 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 861 - DNA, 3231 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 862 - DNA, 3399 bp, Artificial Sequence
  Synthetic Polynucleotide
atggccttaccagtgaccgccttgctcctgccgctggccttgctgctccacgccgccaggccgcaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcggcggaggcggaagtggaggcggaggatctggcggcggaggctctcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 863 - DNA, 3294 bp, Artificial Sequence
  Synthetic Polynucleotide
atggccttaccagtgaccgccttgctcctgccgctggccttgctgctccacgccgccaggccgcaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcggcggaggcggaagtggaggcggaggatctggcggcggaggctctcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 864 - DNA, 3324 bp, Artificial Sequence
  Synthetic Polynucleotide
atggccttaccagtgaccgccttgctcctgccgctggccttgctgctccacgccgccaggccgcaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcggcggaggcggaagtggaggcggaggatctggcggcggaggctctcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 865 - DNA, 3273 bp, Artificial Sequence
  Synthetic Polynucleotide
atggccttaccagtgaccgccttgctcctgccgctggccttgctgctccacgccgccaggccgcaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcggcggaggcggaagtggaggcggaggatctggcggcggaggctctcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 866 - DNA, 2463 bp, Artificial Sequence
  Synthetic Polynucleotide
atggccttaccagtgaccgccttgctcctgccgctggccttgctgctccacgccgccaggccgcaaattgtgctgacacagagccccgccatcatgagcgcttctccaggcgagaaagtgaccatgacctgtagcgccagcagctccgtgtcttacatgcactggtatcagcagaagtccggcacaagccccaagcggtggatctacgataccagcaaactggcctccggcgtgcccgatagattttctggcagcggcagcggaaccagctacttcctgaccatcaacaacatggaagccgaggacgccgccacctactactgccagcagtggaacatcaaccctctgacctttggagccggcaccaagctggaactgaagagactcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctccagcagtctggacctgagctggttaagcctggcgcttccgtgaagatcagctgcaaggcttccggctacgccttcagcagcagctggatgaactgggtcaaacagaggcccggcaaaggactggaatggatcggcagaatctaccccggcgacgaggacaccaattacagcggcaagttcaaggacaaggccacactgaccgccgacaagagcagcaccacagcctacatgcagctgagcagcctgaccagcgaggatagcgccgtgtacttctgtgccagaagcctgctgtacggcgactacctggattattggggccagggcacaaccctgacagtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 867 - DNA, 2649 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 868 - DNA, 2859 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 869 - DNA, 2694 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggggcggaggcggaagtggaggcggaggatctggcggcggaggctctcaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 870 - DNA, 2913 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggggcggaggcggaagtggaggcggaggatctggcggcggaggctctcaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 871 - DNA, 2697 bp, Artificial Sequence
  Synthetic Polynucleotide
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggggcggaggcggaagtggaggcggaggatctggcggcggaggctctcaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 872 - DNA, 2649 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 873 - DNA, 2559 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 874 - DNA, 2805 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 875 - DNA, 2859 bp, Artificial Sequence
  Synthetic Polynucleotide
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggggcggaggcggaagtggaggcggaggatctggcggcggaggctctcaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 876 - DNA, 2670 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 877 - DNA, 2715 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggggcggaggcggaagtggaggcggaggatctggcggcggaggctctcaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 878 - DNA, 2685 bp, Artificial Sequence
  Synthetic Polynucleotide
atggccttaccagtgaccgccttgctcctgccgctggccttgctgctccacgccgccaggccgctcgaggggtctggaggcggaggcagcggcggaggcgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagcatggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggggcggaggcggaagtggaggcggaggatctggcggcggaggctctcaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtggcagcggcggaggcggaagtggaggcggaggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 879 - DNA, 1923 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggggcggaggcggaagtggaggcggaggatctggcggcggaggctctcaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 880 - DNA, 2019 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggggcggaggcggaagtggaggcggaggatctggcggcggaggctctcaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 881 - DNA, 2169 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggggcggaggcggaagtggaggcggaggatctggcggcggaggctctcaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 882 - DNA, 1671 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 883 - DNA, 981 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 884 - DNA, 1383 bp, Artificial Sequence
  Synthetic Polynucleotide
atggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 885 - DNA, 885 bp, Artificial Sequence
  Synthetic Polynucleotide
atggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 886 - DNA, 1503 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggggcggaggcggaagtggaggcggaggatctggcggcggaggctctcaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 887 - DNA, 1503 bp, Artificial Sequence
  Synthetic Polynucleotide
atggccttaccagtgaccgccttgctcctgccgctggccttgctgctccacgccgccaggccgcaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcggcggaggcggaagtggaggcggaggatctggcggcggaggctctgatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 888 - DNA, 2742 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggggcggaggcggaagtggaggcggaggatctggcggcggaggctctcaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 889 - DNA, 2562 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 890 - DNA, 2604 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggctcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 891 - DNA, 2601 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggctcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 892 - DNA, 2589 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggctcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 893 - DNA, 2652 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 894 - DNA, 2640 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggctcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 895 - DNA, 2559 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 896 - DNA, 2781 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 897 - DNA, 2445 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 898 - DNA, 2445 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 899 - DNA, 2658 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 900 - DNA, 2781 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaggagtaagaggagcaggctcctgcacagtgactacatgaacatgactccacgccgccccggacccacccgcaagcattaccagccctatgccccaccacgcgacttcgcagcctatcgctccagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 901 - DNA, 2664 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 902 - DNA, 2790 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 903 - DNA, 2781 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 904 - DNA, 3435 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggggcggaggcggaagtggaggcggaggatctggcggcggaggctctcaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 905 - DNA, 3399 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggggcggaggcggaagtggaggcggaggatctggcggcggaggctctcaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 906 - DNA, 3294 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggggcggaggcggaagtggaggcggaggatctggcggcggaggctctcaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 907 - DNA, 3324 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggggcggaggcggaagtggaggcggaggatctggcggcggaggctctcaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 908 - DNA, 3273 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggggcggaggcggaagtggaggcggaggatctggcggcggaggctctcaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 909 - DNA, 3381 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 910 - DNA, 3231 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 911 - DNA, 3399 bp, Artificial Sequence
  Synthetic Polynucleotide
atggccttaccagtgaccgccttgctcctgccgctggccttgctgctccacgccgccaggccgcaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcggcggaggcggaagtggaggcggaggatctggcggcggaggctctgatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 912 - DNA, 3294 bp, Artificial Sequence
  Synthetic Polynucleotide
atggccttaccagtgaccgccttgctcctgccgctggccttgctgctccacgccgccaggccgcaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcggcggaggcggaagtggaggcggaggatctggcggcggaggctctgatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 913 - DNA, 3324 bp, Artificial Sequence
  Synthetic Polynucleotide
atggccttaccagtgaccgccttgctcctgccgctggccttgctgctccacgccgccaggccgcaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcggcggaggcggaagtggaggcggaggatctggcggcggaggctctgatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 914 - DNA, 3273 bp, Artificial Sequence
  Synthetic Polynucleotide
atggccttaccagtgaccgccttgctcctgccgctggccttgctgctccacgccgccaggccgcaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcggcggaggcggaagtggaggcggaggatctggcggcggaggctctgatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 915 - DNA, 2463 bp, Artificial Sequence
  Synthetic Polynucleotide
atggccttaccagtgaccgccttgctcctgccgctggccttgctgctccacgccgccaggccggatattcagatgacacagagccccagcagcctgtctgcctctgtgggagatcgcgtgaccattacctgtagcgccagcagctccgtgtcctacatgcactggtatcagcagaagcccggcaaggcccctaagctgctgatctacgataccagcaagctggcctctggcgtgcccagcagattttctggctctggctatggcaccgacttcaccctgacaatatccagcctccagcctgaggacttcgccacctactactgccagcagtggaacatcaaccctctgacctttggaggcggcaccaaggtggaaatcaagcggctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagcagcagctggatgaactgggtccgacaggctcctggacagggccttgaatggatgggcagaatctaccccggcgacgaggacaccaattacagcggcaagttcaaggacagagtgaccatcaccgccgacgagagcacaagcaccgcctacatggaactgagcagcctgagaagcgaggataccgccgtgtactactgcgctagaagcctgctgtacggcgactacctggattattggggccagggcacactggtcacagtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 916 - DNA, 2649 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 917 - DNA, 2859 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 918 - DNA, 2694 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaaggcggaggcggaagtggaggcggaggatctggcggcggaggctctcaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 919 - DNA, 2913 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaaggcggaggcggaagtggaggcggaggatctggcggcggaggctctcaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 920 - DNA, 2697 bp, Artificial Sequence
  Synthetic Polynucleotide
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaaggcggaggcggaagtggaggcggaggatctggcggcggaggctctcaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 921 - DNA, 2649 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 922 - DNA, 2559 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 923 - DNA, 2805 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 924 - DNA, 2859 bp, Artificial Sequence
  Synthetic Polynucleotide
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaaggcggaggcggaagtggaggcggaggatctggcggcggaggctctcaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 925 - DNA, 2670 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 926 - DNA, 2715 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaaggcggaggcggaagtggaggcggaggatctggcggcggaggctctcaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 927 - DNA, 2685 bp, Artificial Sequence
  Synthetic Polynucleotide
atggccttaccagtgaccgccttgctcctgccgctggccttgctgctccacgccgccaggccgctcgaggggtctggaggcggaggcagcggcggaggcgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagcatggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaaggcggaggcggaagtggaggcggaggatctggcggcggaggctctcaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtggcagcggcggaggcggaagtggaggcggaggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 928 - DNA, 1923 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaaggcggaggcggaagtggaggcggaggatctggcggcggaggctctcaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 929 - DNA, 2019 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaaggcggaggcggaagtggaggcggaggatctggcggcggaggctctcaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 930 - DNA, 2169 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaaggcggaggcggaagtggaggcggaggatctggcggcggaggctctcaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 931 - DNA, 1668 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 932 - DNA, 978 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 933 - DNA, 1386 bp, Artificial Sequence
  Synthetic Polynucleotide
atggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 934 - DNA, 888 bp, Artificial Sequence
  Synthetic Polynucleotide
atggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 935 - DNA, 1503 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaaggcggaggcggaagtggaggcggaggatctggcggcggaggctctcaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 936 - DNA, 1503 bp, Artificial Sequence
  Synthetic Polynucleotide
atggccttaccagtgaccgccttgctcctgccgctggccttgctgctccacgccgccaggccgcaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctggcggaggcggaagtggaggcggaggatctggcggcggaggctctgagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 937 - DNA, 2742 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaaggcggaggcggaagtggaggcggaggatctggcggcggaggctctcaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 938 - DNA, 2562 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 939 - DNA, 2604 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 940 - DNA, 2601 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 941 - DNA, 2589 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 942 - DNA, 2652 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 943 - DNA, 2640 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaactcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 944 - DNA, 2559 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 945 - DNA, 2781 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaaggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 946 - DNA, 2445 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 947 - DNA, 2445 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 948 - DNA, 2658 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 949 - DNA, 2781 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaggagtaagaggagcaggctcctgcacagtgactacatgaacatgactccacgccgccccggacccacccgcaagcattaccagccctatgccccaccacgcgacttcgcagcctatcgctccagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 950 - DNA, 2664 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 951 - DNA, 2790 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 952 - DNA, 2781 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaaggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 953 - DNA, 3435 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaaggcggaggcggaagtggaggcggaggatctggcggcggaggctctcaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 954 - DNA, 3399 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaaggcggaggcggaagtggaggcggaggatctggcggcggaggctctcaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 955 - DNA, 3294 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaaggcggaggcggaagtggaggcggaggatctggcggcggaggctctcaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 956 - DNA, 3324 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaaggcggaggcggaagtggaggcggaggatctggcggcggaggctctcaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 957 - DNA, 3273 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaaggcggaggcggaagtggaggcggaggatctggcggcggaggctctcaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 958 - DNA, 3381 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 959 - DNA, 3231 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 960 - DNA, 3399 bp, Artificial Sequence
  Synthetic Polynucleotide
atggccttaccagtgaccgccttgctcctgccgctggccttgctgctccacgccgccaggccgcaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctggcggaggcggaagtggaggcggaggatctggcggcggaggctctgagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 961 - DNA, 3294 bp, Artificial Sequence
  Synthetic Polynucleotide
atggccttaccagtgaccgccttgctcctgccgctggccttgctgctccacgccgccaggccgcaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctggcggaggcggaagtggaggcggaggatctggcggcggaggctctgagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 962 - DNA, 3324 bp, Artificial Sequence
  Synthetic Polynucleotide
atggccttaccagtgaccgccttgctcctgccgctggccttgctgctccacgccgccaggccgcaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctggcggaggcggaagtggaggcggaggatctggcggcggaggctctgagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 963 - DNA, 3273 bp, Artificial Sequence
  Synthetic Polynucleotide
atggccttaccagtgaccgccttgctcctgccgctggccttgctgctccacgccgccaggccgcaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctggcggaggcggaagtggaggcggaggatctggcggcggaggctctgagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 964 - DNA, 2463 bp, Artificial Sequence
  Synthetic Polynucleotide
atggccttaccagtgaccgccttgctcctgccgctggccttgctgctccacgccgccaggccggagaacgtgctgacacagtctccagccacactgagcgtgacacctggcgagaaggccaccatcacatgtagagccagccagagcgtgtcctacatgcactggtatcagcagaagcccggacaggcccctagactgctgatctacgacgccagcaatagagcctctggcgtgcccagcagattttctggctctggcagcggcaccgatcacaccctgacaatctctagcctggaagccgaagatgccgccacctactactgcttccaaggcagcgtgtaccccttcacattcggccagggcaccaagctggaaatcaaactcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagtgacactgagagagtctggccccgctctggtcaagcctacacagaccctgacactgacctgcaccttcagcggctttagcctgagcacatctggcatgggcgtcggctggattagacagcctcctggaaaagccctggaatggctggcccacatttggtgggacgacgacaagagatacaaccccgcactgaagtcccggctgaccatcagcaaggacaccagcaagaaccaggtgttcctgaccatgaccaacatggaccccgtggacaccgccacatattactgcgcccggatggaactgtggtcctactacttcgactactggggccagggaaccaccgtgacagtctcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 965 - DNA, 2676 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 966 - DNA, 2886 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 967 - DNA, 2721 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctggcggaggcggaagtggaggcggaggatctggcggcggaggctctcaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 968 - DNA, 2940 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctggcggaggcggaagtggaggcggaggatctggcggcggaggctctcaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 969 - DNA, 2724 bp, Artificial Sequence
  Synthetic Polynucleotide
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctggcggaggcggaagtggaggcggaggatctggcggcggaggctctcaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 970 - DNA, 2676 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 971 - DNA, 2586 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 972 - DNA, 2832 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 973 - DNA, 2886 bp, Artificial Sequence
  Synthetic Polynucleotide
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctggcggaggcggaagtggaggcggaggatctggcggcggaggctctcaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 974 - DNA, 2697 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 975 - DNA, 2742 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctggcggaggcggaagtggaggcggaggatctggcggcggaggctctcaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 976 - DNA, 2712 bp, Artificial Sequence
  Synthetic Polynucleotide
atggccttaccagtgaccgccttgctcctgccgctggccttgctgctccacgccgccaggccgctcgaggggtctggaggcggaggcagcggcggaggcgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagcatggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctggcggaggcggaagtggaggcggaggatctggcggcggaggctctcaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtggcagcggcggaggcggaagtggaggcggaggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 977 - DNA, 1950 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctggcggaggcggaagtggaggcggaggatctggcggcggaggctctcaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 978 - DNA, 2046 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctggcggaggcggaagtggaggcggaggatctggcggcggaggctctcaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 979 - DNA, 2196 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctggcggaggcggaagtggaggcggaggatctggcggcggaggctctcaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 980 - DNA, 1686 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 981 - DNA, 996 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 982 - DNA, 1395 bp, Artificial Sequence
  Synthetic Polynucleotide
atggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 983 - DNA, 897 bp, Artificial Sequence
  Synthetic Polynucleotide
atggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 984 - DNA, 1530 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctggcggaggcggaagtggaggcggaggatctggcggcggaggctctcaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 985 - DNA, 1530 bp, Artificial Sequence
  Synthetic Polynucleotide
atggccttaccagtgaccgccttgctcctgccgctggccttgctgctccacgccgccaggccgcaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctggcggaggcggaagtggaggcggaggatctggcggcggaggctctgacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 986 - DNA, 2769 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctggcggaggcggaagtggaggcggaggatctggcggcggaggctctcaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 987 - DNA, 2589 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 988 - DNA, 2631 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctctcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 989 - DNA, 2628 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctctcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 990 - DNA, 2616 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctctcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 991 - DNA, 2679 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 992 - DNA, 2667 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctctcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 993 - DNA, 2586 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 994 - DNA, 2808 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 995 - DNA, 2472 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 996 - DNA, 2472 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 997 - DNA, 2685 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 998 - DNA, 2808 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaggagtaagaggagcaggctcctgcacagtgactacatgaacatgactccacgccgccccggacccacccgcaagcattaccagccctatgccccaccacgcgacttcgcagcctatcgctccagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 999 - DNA, 2691 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 1000 - DNA, 2817 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 1001 - DNA, 2808 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1002 - DNA, 3462 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctggcggaggcggaagtggaggcggaggatctggcggcggaggctctcaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1003 - DNA, 3426 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctggcggaggcggaagtggaggcggaggatctggcggcggaggctctcaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1004 - DNA, 3321 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctggcggaggcggaagtggaggcggaggatctggcggcggaggctctcaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1005 - DNA, 3351 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctggcggaggcggaagtggaggcggaggatctggcggcggaggctctcaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1006 - DNA, 3300 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctggcggaggcggaagtggaggcggaggatctggcggcggaggctctcaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1007 - DNA, 3408 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 1008 - DNA, 3258 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 1009 - DNA, 2562 bp, Artificial Sequence
  Synthetic Polynucleotide
atggccttaccagtgaccgccttgctcctgccgctggccttgctgctccacgccgccaggccgcaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctggcggaggcggaagtggaggcggaggatctggcggcggaggctctgacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccc

SEQ ID NO: 1010 - DNA, 3321 bp, Artificial Sequence
  Synthetic Polynucleotide
atggccttaccagtgaccgccttgctcctgccgctggccttgctgctccacgccgccaggccgcaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctggcggaggcggaagtggaggcggaggatctggcggcggaggctctgacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1011 - DNA, 3351 bp, Artificial Sequence
  Synthetic Polynucleotide
atggccttaccagtgaccgccttgctcctgccgctggccttgctgctccacgccgccaggccgcaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctggcggaggcggaagtggaggcggaggatctggcggcggaggctctgacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1012 - DNA, 3300 bp, Artificial Sequence
  Synthetic Polynucleotide
atggccttaccagtgaccgccttgctcctgccgctggccttgctgctccacgccgccaggccgcaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctggcggaggcggaagtggaggcggaggatctggcggcggaggctctgacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1013 - DNA, 2490 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacatgcaaggccagcgaccacatcaacaactggctggcctggtatcagcagaagcctggcaaggcccctaagctgctgatctacggcgctaccacactggaaacaggcgtgcccagcagattttccggcagcggctatggcaccgacttcaccctgacaatatccagcctccagcctgaggacttcgccacctactactgtcagcagagctggaacaccccttggacctttggcggcggaacaaaggtggaaatcaagagaacagtggccgctctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagagcggagccgaagtgaagaaacctggcagcagcgtgaaggtgtcctgcaaagcctctggctacgccttcagcagctactgggtcaactgggttcgacaggcccctggacaaggactggaatggatgggccaaatctaccccggcgacggcgacaccaactacaacggcaagttcaagggccgcgtgacaatcaccgccgatgagagcacaagcaccgcctacatggaactgagcagcctgagaagcgaggacaccgccgtgtactactgtgccagatccatcaccaccgtcgtgggctgcgctatggattattggggccagggcacactggtcaccgtgtctagtgcttctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1014 - DNA, 2664 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1015 - DNA, 2874 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1016 - DNA, 2709 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagggcggaggcggaagtggaggcggaggatctggcggcggaggctctcaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1017 - DNA, 2928 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagggcggaggcggaagtggaggcggaggatctggcggcggaggctctcaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1018 - DNA, 2712 bp, Artificial Sequence
  Synthetic Polynucleotide
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagggcggaggcggaagtggaggcggaggatctggcggcggaggctctcaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1019 - DNA, 2664 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1020 - DNA, 2574 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1021 - DNA, 2820 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1022 - DNA, 2874 bp, Artificial Sequence
  Synthetic Polynucleotide
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagggcggaggcggaagtggaggcggaggatctggcggcggaggctctcaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1023 - DNA, 2685 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1024 - DNA, 2730 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagggcggaggcggaagtggaggcggaggatctggcggcggaggctctcaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1025 - DNA, 2700 bp, Artificial Sequence
  Synthetic Polynucleotide
atggccttaccagtgaccgccttgctcctgccgctggccttgctgctccacgccgccaggccgctcgaggggtctggaggcggaggcagcggcggaggcgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagcatggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagggcggaggcggaagtggaggcggaggatctggcggcggaggctctcaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtggcagcggcggaggcggaagtggaggcggaggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1026 - DNA, 1938 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagggcggaggcggaagtggaggcggaggatctggcggcggaggctctcaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1027 - DNA, 2034 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagggcggaggcggaagtggaggcggaggatctggcggcggaggctctcaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1028 - DNA, 2184 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagggcggaggcggaagtggaggcggaggatctggcggcggaggctctcaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1029 - DNA, 1686 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1030 - DNA, 996 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 1031 - DNA, 1383 bp, Artificial Sequence
  Synthetic Polynucleotide
atggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 1032 - DNA, 885 bp, Artificial Sequence
  Synthetic Polynucleotide
atggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 1033 - DNA, 1518 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagggcggaggcggaagtggaggcggaggatctggcggcggaggctctcaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1034 - DNA, 1518 bp, Artificial Sequence
  Synthetic Polynucleotide
atggccttaccagtgaccgccttgctcctgccgctggccttgctgctccacgccgccaggccgcaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcggcggaggcggaagtggaggcggaggatctggcggcggaggctctgatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1035 - DNA, 2757 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagggcggaggcggaagtggaggcggaggatctggcggcggaggctctcaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1036 - DNA, 2577 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1037 - DNA, 2619 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagctcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1038 - DNA, 2616 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagctcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1039 - DNA, 2604 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagctcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1040 - DNA, 2667 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1041 - DNA, 2655 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagctcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1042 - DNA, 2574 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1043 - DNA, 2796 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1044 - DNA, 2460 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 1045 - DNA, 2460 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 1046 - DNA, 2673 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 1047 - DNA, 2796 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaggagtaagaggagcaggctcctgcacagtgactacatgaacatgactccacgccgccccggacccacccgcaagcattaccagccctatgccccaccacgcgacttcgcagcctatcgctccagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 1048 - DNA, 2679 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 1049 - DNA, 2805 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 1050 - DNA, 2796 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1051 - DNA, 3450 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagggcggaggcggaagtggaggcggaggatctggcggcggaggctctcaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1052 - DNA, 3414 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagggcggaggcggaagtggaggcggaggatctggcggcggaggctctcaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1053 - DNA, 3309 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagggcggaggcggaagtggaggcggaggatctggcggcggaggctctcaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1054 - DNA, 3339 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagggcggaggcggaagtggaggcggaggatctggcggcggaggctctcaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1055 - DNA, 3288 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagggcggaggcggaagtggaggcggaggatctggcggcggaggctctcaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1056 - DNA, 3396 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 1057 - DNA, 3246 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 1058 - DNA, 3414 bp, Artificial Sequence
  Synthetic Polynucleotide
atggccttaccagtgaccgccttgctcctgccgctggccttgctgctccacgccgccaggccgcaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcggcggaggcggaagtggaggcggaggatctggcggcggaggctctgatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1059 - DNA, 3309 bp, Artificial Sequence
  Synthetic Polynucleotide
atggccttaccagtgaccgccttgctcctgccgctggccttgctgctccacgccgccaggccgcaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcggcggaggcggaagtggaggcggaggatctggcggcggaggctctgatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1060 - DNA, 3339 bp, Artificial Sequence
  Synthetic Polynucleotide
atggccttaccagtgaccgccttgctcctgccgctggccttgctgctccacgccgccaggccgcaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcggcggaggcggaagtggaggcggaggatctggcggcggaggctctgatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1061 - DNA, 3288 bp, Artificial Sequence
  Synthetic Polynucleotide
atggccttaccagtgaccgccttgctcctgccgctggccttgctgctccacgccgccaggccgcaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcggcggaggcggaagtggaggcggaggatctggcggcggaggctctgatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1062 - DNA, 2478 bp, Artificial Sequence
  Synthetic Polynucleotide
atggccttaccagtgaccgccttgctcctgccgctggccttgctgctccacgccgccaggccggatattgtgatgacccagacacctctgagcctgcctgtgacacctggcgaacctgccagcatcagctgtagaagcagcaagagcctgctgcacagcaacggcatcacctacctgtactggtatctccagaagccaggccagtctcctcagctgctgatctaccagatgagcaacctggtgtccggcgtgcccgatagattttctggcagcggctctggcaccgacttcaccctgaagattagcagagtggaagccgaggacgtgggcgtgtactattgtgcccagaacctggaactgccctacacctttggcggcggaacaaaggtggaaatcaagctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaggttcagctggttcagtctggggccgaagtgaagaaacctggcagcagcgtgaaggtgtcctgcaaggcttctggctacgccttcagctacagctggatcaactgggtccgacaggcccctggacaaggactggaatggatgggcagaatcttccccggcgacggcgacaccgattacaacggcaagttcaagggcagagtgaccatcaccgccgacaagagcacaagcaccgcctacatggaactgagcagcctgagaagcgaggacaccgccgtgtactactgcgccagaaacgtgttcgacggctactggctggtgtattggggccagggaacactggtcacagtgtctagcacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1063 - DNA, 2664 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1064 - DNA, 2874 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1065 - DNA, 2709 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccggcggaggcggaagtggaggcggaggatctggcggcggaggctctcaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1066 - DNA, 2928 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccggcggaggcggaagtggaggcggaggatctggcggcggaggctctcaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1067 - DNA, 2712 bp, Artificial Sequence
  Synthetic Polynucleotide
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccggcggaggcggaagtggaggcggaggatctggcggcggaggctctcaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1068 - DNA, 2664 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1069 - DNA, 2574 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1070 - DNA, 2820 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1071 - DNA, 2874 bp, Artificial Sequence
  Synthetic Polynucleotide
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccggcggaggcggaagtggaggcggaggatctggcggcggaggctctcaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1072 - DNA, 2685 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1073 - DNA, 2730 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccggcggaggcggaagtggaggcggaggatctggcggcggaggctctcaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1074 - DNA, 2700 bp, Artificial Sequence
  Synthetic Polynucleotide
atggccttaccagtgaccgccttgctcctgccgctggccttgctgctccacgccgccaggccgctcgaggggtctggaggcggaggcagcggcggaggcgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagcatggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccggcggaggcggaagtggaggcggaggatctggcggcggaggctctcaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtggcagcggcggaggcggaagtggaggcggaggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1075 - DNA, 1938 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccggcggaggcggaagtggaggcggaggatctggcggcggaggctctcaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1076 - DNA, 2034 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccggcggaggcggaagtggaggcggaggatctggcggcggaggctctcaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1077 - DNA, 2184 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccggcggaggcggaagtggaggcggaggatctggcggcggaggctctcaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1078 - DNA, 1683 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1079 - DNA, 993 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 1080 - DNA, 1386 bp, Artificial Sequence
  Synthetic Polynucleotide
atggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 1081 - DNA, 888 bp, Artificial Sequence
  Synthetic Polynucleotide
atggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 1082 - DNA, 1518 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccggcggaggcggaagtggaggcggaggatctggcggcggaggctctcaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1083 - DNA, 1518 bp, Artificial Sequence
  Synthetic Polynucleotide
atggccttaccagtgaccgccttgctcctgccgctggccttgctgctccacgccgccaggccgcaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccggcggaggcggaagtggaggcggaggatctggcggcggaggctctgacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1084 - DNA, 2757 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccggcggaggcggaagtggaggcggaggatctggcggcggaggctctcaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1085 - DNA, 2577 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1086 - DNA, 2619 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccctcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1087 - DNA, 2616 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccctcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1088 - DNA, 2604 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccctcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1089 - DNA, 2667 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1090 - DNA, 2655 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccctcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1091 - DNA, 2574 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1092 - DNA, 2796 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1093 - DNA, 2460 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 1094 - DNA, 2460 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 1095 - DNA, 2673 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 1096 - DNA, 2796 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaggagtaagaggagcaggctcctgcacagtgactacatgaacatgactccacgccgccccggacccacccgcaagcattaccagccctatgccccaccacgcgacttcgcagcctatcgctccagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 1097 - DNA, 2679 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 1098 - DNA, 2805 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 1099 - DNA, 2796 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1100 - DNA, 3450 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccggcggaggcggaagtggaggcggaggatctggcggcggaggctctcaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1101 - DNA, 3414 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccggcggaggcggaagtggaggcggaggatctggcggcggaggctctcaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1102 - DNA, 3309 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccggcggaggcggaagtggaggcggaggatctggcggcggaggctctcaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1103 - DNA, 3339 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccggcggaggcggaagtggaggcggaggatctggcggcggaggctctcaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1104 - DNA, 3288 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccggcggaggcggaagtggaggcggaggatctggcggcggaggctctcaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1105 - DNA, 3396 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 1106 - DNA, 3246 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccctcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 1107 - DNA, 3414 bp, Artificial Sequence
  Synthetic Polynucleotide
atggccttaccagtgaccgccttgctcctgccgctggccttgctgctccacgccgccaggccgcaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccggcggaggcggaagtggaggcggaggatctggcggcggaggctctgacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1108 - DNA, 3309 bp, Artificial Sequence
  Synthetic Polynucleotide
atggccttaccagtgaccgccttgctcctgccgctggccttgctgctccacgccgccaggccgcaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccggcggaggcggaagtggaggcggaggatctggcggcggaggctctgacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1109 - DNA, 3339 bp, Artificial Sequence
  Synthetic Polynucleotide
atggccttaccagtgaccgccttgctcctgccgctggccttgctgctccacgccgccaggccgcaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccggcggaggcggaagtggaggcggaggatctggcggcggaggctctgacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1110 - DNA, 3288 bp, Artificial Sequence
  Synthetic Polynucleotide
atggccttaccagtgaccgccttgctcctgccgctggccttgctgctccacgccgccaggccgcaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccggcggaggcggaagtggaggcggaggatctggcggcggaggctctgacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1111 - DNA, 2478 bp, Artificial Sequence
  Synthetic Polynucleotide
atggccttaccagtgaccgccttgctcctgccgctggccttgctgctccacgccgccaggccggacatccagatgacacagagccctagcagcctgtctgccagcgtgggagacagagtgaccatcacctgtagagccagcagcagcgtgtcctacatgcactggtatcagcagaagcccggcaaggcccctaagctgctgatctacgccaccagcaatctggcctctggcgtgccaagcagattttctggcagcggctctggcaccgacttcaccctgacaatatccagcctccagcctgaggacttcgccacctactactgccagcagtggaccttcaatcctcctaccttcggccagggcaccaagctggaaatcaagagaacagtggctgccctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctggttcagtctggggccgaagtgaagaaacctggggcctctgtgaaggtgtcctgcaaggcttccggctacacctttaccagctacaatatgcactgggtccgacaggctcccggccagagacttgaatggatgggcggcatctaccccggcaatggcgacacctcctacaaccagaaattcaagggccgcgtgacaatcaccagagacacctctgccagcaccgcctacatggaactgagcagcctgagaagcgaggacaccgccgtgtactactgcgccagatacgactacaactacgctatggactactggggccagggaaccctggtcacagtgtctagtgcttccacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1112 - DNA, 2658 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1113 - DNA, 2868 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1114 - DNA, 2703 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagaggcggaggcggaagtggaggcggaggatctggcggcggaggctctcaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1115 - DNA, 2922 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagaggcggaggcggaagtggaggcggaggatctggcggcggaggctctcaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1116 - DNA, 2706 bp, Artificial Sequence
  Synthetic Polynucleotide
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagaggcggaggcggaagtggaggcggaggatctggcggcggaggctctcaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1117 - DNA, 2658 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1118 - DNA, 2568 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1119 - DNA, 2814 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1120 - DNA, 2868 bp, Artificial Sequence
  Synthetic Polynucleotide
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagaggcggaggcggaagtggaggcggaggatctggcggcggaggctctcaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1121 - DNA, 2679 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagactcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1122 - DNA, 2724 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagaggcggaggcggaagtggaggcggaggatctggcggcggaggctctcaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1123 - DNA, 2694 bp, Artificial Sequence
  Synthetic Polynucleotide
atggccttaccagtgaccgccttgctcctgccgctggccttgctgctccacgccgccaggccgctcgaggggtctggaggcggaggcagcggcggaggcgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagcatggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagaggcggaggcggaagtggaggcggaggatctggcggcggaggctctcaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtggcagcggcggaggcggaagtggaggcggaggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1124 - DNA, 1932 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagaggcggaggcggaagtggaggcggaggatctggcggcggaggctctcaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1125 - DNA, 2028 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagaggcggaggcggaagtggaggcggaggatctggcggcggaggctctcaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1126 - DNA, 2178 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagaggcggaggcggaagtggaggcggaggatctggcggcggaggctctcaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1127 - DNA, 1674 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1128 - DNA, 984 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 1129 - DNA, 1389 bp, Artificial Sequence
  Synthetic Polynucleotide
atggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 1130 - DNA, 891 bp, Artificial Sequence
  Synthetic Polynucleotide
atggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 1131 - DNA, 1512 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagaggcggaggcggaagtggaggcggaggatctggcggcggaggctctcaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1132 - DNA, 1512 bp, Artificial Sequence
  Synthetic Polynucleotide
atggccttaccagtgaccgccttgctcctgccgctggccttgctgctccacgccgccaggccgcaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctggcggaggcggaagtggaggcggaggatctggcggcggaggctctgacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagaacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1133 - DNA, 2751 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagaggcggaggcggaagtggaggcggaggatctggcggcggaggctctcaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1134 - DNA, 2571 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagactcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1135 - DNA, 2613 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagactcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1136 - DNA, 2610 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagactcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1137 - DNA, 2598 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagactcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1138 - DNA, 2661 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagactcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1139 - DNA, 2649 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagactcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1140 - DNA, 2568 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1141 - DNA, 2790 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagaggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1142 - DNA, 2454 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagactcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 1143 - DNA, 2454 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagactcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 1144 - DNA, 2667 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 1145 - DNA, 2790 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaggagtaagaggagcaggctcctgcacagtgactacatgaacatgactccacgccgccccggacccacccgcaagcattaccagccctatgccccaccacgcgacttcgcagcctatcgctccagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 1146 - DNA, 2673 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 1147 - DNA, 2799 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagactcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 1148 - DNA, 2790 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagaggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcctcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1149 - DNA, 3444 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagaggcggaggcggaagtggaggcggaggatctggcggcggaggctctcaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1150 - DNA, 3408 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagaggcggaggcggaagtggaggcggaggatctggcggcggaggctctcaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1151 - DNA, 3303 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagaggcggaggcggaagtggaggcggaggatctggcggcggaggctctcaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1152 - DNA, 3333 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagaggcggaggcggaagtggaggcggaggatctggcggcggaggctctcaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1153 - DNA, 3282 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagaggcggaggcggaagtggaggcggaggatctggcggcggaggctctcaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1154 - DNA, 3390 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagccccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagccacctgacttctgctgtcccaagtgccagtatcaggcccctgatatggacaccctgcagatacatgtcatggagtgcattgagtga

SEQ ID NO: 1155 - DNA, 3240 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagactcgagggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtgcctctacaaagggaccctccgtgtttcctctggctcccagcagcaagtctacaagcggaggaacagccgctctgggctgcctggtcaaggattactttcccgagcctgtgaccgtgtcctggaatagcggagcactgacaagcggcgtgcacacctttccagccgtgctgcaaagcagcggcctgtactctctgagcagcgtggtcacagtgcctagctctagcctgggcacccagacctacatctgcaatgtgaaccacaagcctagcaacaccaaggtggacaagagagtggaacccaagagctgtatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtga

SEQ ID NO: 1156 - DNA, 3408 bp, Artificial Sequence
  Synthetic Polynucleotide
atggccttaccagtgaccgccttgctcctgccgctggccttgctgctccacgccgccaggccgcaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctggcggaggcggaagtggaggcggaggatctggcggcggaggctctgacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagaacgcgtgacggtaacgaggagatgggaggaatcactcaaaccccttacaaagtctcaatttcaggaacaactgttatccttacatgtccccagtatcctggcagcgagatcctttggcagcataacgacaagaatatagggggagatgaagacgataagaatatcggatctgacgaggatcacttgagcctgaaagagttctccgagcttgaacaaagcggatattatgtgtgctatccgcgcgggtcaaagccggaagacgctaacttttacctttatctccgagccagagtgtgcgaaaattgcatggaaatggacgttatgtccgttgctacaatagttatcgtagatatatgcatcacgggtggactgcttctgctggtttattattggtccaagaatagaaaggccaaagctaaacccgtgaccagaggcgctggcgcaggcggaaggcaaaggggacaaaacaaagaacggccaccaccagtgccaaatccagattatgagcctattcggaaaggacagagggacctgtactctggcctgaatcagagaagaatctctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1157 - DNA, 3303 bp, Artificial Sequence
  Synthetic Polynucleotide
atggccttaccagtgaccgccttgctcctgccgctggccttgctgctccacgccgccaggccgcaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctggcggaggcggaagtggaggcggaggatctggcggcggaggctctgacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagaacgcgtttcaagatccccatcgaggaactggaagatcgggtgttcgtgaactgcaacacctctatcacctgggtggaaggcaccgtgggaacactgctgagcgacatcaccagactggacctcggcaagcggattctggaccctcggggcatctacagatgcaacggcaccgacatctacaaggacaaagaaagcaccgtgcaggtccactacagaatgtgccagtcctgcgtggaactggaccctgctacagtggccggcatcatcgtgaccgatgtgatcgctactctgctgctggctctgggagtgttctgcttcgccggacacgaaacaggcagactgtctggcgctgccgatacacaggccctgctgagaaacgaccaagtgtatcagcccctgcgcgacagagatgatgcccagtattctcacctcggcggcaactgggctagaaacaagtctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1158 - DNA, 3333 bp, Artificial Sequence
  Synthetic Polynucleotide
atggccttaccagtgaccgccttgctcctgccgctggccttgctgctccacgccgccaggccgcaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctggcggaggcggaagtggaggcggaggatctggcggcggaggctctgacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagaacgcgtcagagcatcaagggcaaccacctggtcaaggtgtacgactaccaagaggacggcagcgtgctgctgacatgtgatgccgaggccaagaacatcacctggtttaaggacggcaagatgatcggcttcctgaccgaggacaagaagaagtggaacctgggcagcaacgctaaggaccccagaggcatgtatcagtgcaagggcagccagaacaagagcaagcccctccaggtgtactaccggatgtgccagaactgcatcgagctgaacgccgctaccatcagcggctttctgttcgccgagatcgtgtccatcttcgtgctggccgtgggcgtgtactttatcgctggacaggatggcgtgcggcagagcagagcttccgataagcaaaccctgctgcctaacgaccagctgtaccagcctctgaaggacagagaggacgaccagtacagccacctccagggcaatcagctgagaagaaactctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1159 - DNA, 3282 bp, Artificial Sequence
  Synthetic Polynucleotide
atggccttaccagtgaccgccttgctcctgccgctggccttgctgctccacgccgccaggccgcaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctggcggaggcggaagtggaggcggaggatctggcggcggaggctctgacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagaacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagatctagaggatctggagcaacaaacttctcactactcaaacaagcaggtgacgtggaggagaatcccgggcctgggatccacatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccgcacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagctcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1160 - DNA, 2472 bp, Artificial Sequence
  Synthetic Polynucleotide
atggccttaccagtgaccgccttgctcctgccgctggccttgctgctccacgccgccaggccggacatccagatgacacagagcagcgcctacctgagcgtgtcccttggaggcagagtgaccatcacatgcaaggccagcgaccacatcaacaactggctggcctggtatcagcacaagcccggcaatgcccctagactgctgatctctggcgctaccacactggaaacaggcgtgcccagcagattttctggcagcggctctggcaaggactacaccctgagcatcaccagcctccagaccgaggatgtggctacctactactgccagcagagctggaacaccccttggacatttggcggaggcaccaagctggaaatcaagagactcgagcagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaacaagttcagctgcaacagagcggagccgagcttgtcagacctggcagctctgtgaagattagctgcaaagccagcggctacgccttcagcagctactgggtcaactggatgaagcagcggcctggacagggcctcgaatggatcggccaaatctatcctggcgacggcgacaccaactacaacggcaagtttaagggcagagccaccgtgaccgccgacaagagcagcagcacatcctacatgcagttcagcagcctgaccagcgaggacagcgccgtgtatttctgtgccagatccatcaccaccgtcgtgggctgcgctatggattattggggccagggcacaagcgtgaccgtgtcatctacgcgtcagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1161 - DNA, 2649 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1162 - DNA, 2859 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1163 - DNA, 2694 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccggcggaggcggaagtggaggcggaggatctggcggcggaggctctgaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1164 - DNA, 2913 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccggcggaggcggaagtggaggcggaggatctggcggcggaggctctgaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1165 - DNA, 2697 bp, Artificial Sequence
  Synthetic Polynucleotide
atggccttaccagtgaccgccttgctcctgccgctggccttgctgctccacgccgccaggccgctcgagcagaaactgatctcggaagaggatctgggctccggcgatcgccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctctagtcgcgccaagagaagcggatctggcgtgaagcagaccctgaatttcgacctgctgaagctggctggcgacgtggaatccaacccaggccccactagcatggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccggcggaggcggaagtggaggcggaggatctggcggcggaggctctgaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtgggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1166 - DNA, 2649 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1167 - DNA, 2559 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1168 - DNA, 2805 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtgagcagaaactgatctcggaagaggatgggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1169 - DNA, 2859 bp, Artificial Sequence
  Synthetic Polynucleotide
atggccttaccagtgaccgccttgctcctgccgctggccttgctgctccacgccgccaggccgctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccggcggaggcggaagtggaggcggaggatctggcggcggaggctctgaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1170 - DNA, 2670 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1171 - DNA, 2715 bp, Artificial Sequence
  Synthetic Polynucleotide
atggccttaccagtgaccgccttgctcctgccgctggccttgctgctccacgccgccaggccgctcgaggggaaaccaattcccaaccctcttctgggactggattcaaccggcagcggcgacaagcagctggacgccgacgtgtcccccaagcctaccatcttcctgccctctatcgccgagacaaagctccagaaggccggcacctacctgtgcctgctggaaaagttcttcccagatgtgattaagatccactggcaggaaaagaagtccaacaccatcctgggcagccaggaaggcaacaccatgaagaccaacgacacctacatgaagttcagctggctgaccgtgcccgagaagtccctggacaaagaacacagatgcatcgtgcggcacgaaaacaacaagaacggcgtggaccaggaaatcatcttcccacccatcaagaccgatgtgattacaatggaccccaaggacaactgctccaaggacgccaacgataccctgctgctccagctgaccaacaccagcgcctactacatgtacttgttgctgctgctgaagtccgtggtgtacttcgccatcatcacatgctgcctgctgcggagaaccgccttctgctgcaacggcgagaagtctagggccaagcgatctggatctggagcaacaaacttctcactactcaaacaagcaggtgacgtggaggagaatcccgggcctactagcatggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccggcggaggcggaagtggaggcggaggatctggcggcggaggctctgaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtgagcagaaactgatctcggaagaggatgggagcggcagccagcctcacaccaagcccagcgtgttcgtgatgaagaacggcaccaacgtggcctgcctcgtgaaagagttctaccccaaggacatcaggatcaacctggtgtccagcaagaagatcaccgagttcgaccccgccatcgtgatctcccccagcggcaagtacaacgccgtgaagctggggaagtacgaggacagcaacagcgtgacctgctccgtgcagcacgacaacaagaccgtgcacagcaccgactttgaagtgaaaaccgactccaccgaccacgtgaagcccaaagagacagagaacaccaagcagcccagcaagagctgccacaagcccaaggccatcgtgcacaccgagaaagtgaacatgatgagcctgaccgtgctgggcctgcggatgctgttcgccaaaaccgtggccgtgaacttcctgctgaccgccaagctgttcttcctccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1172 - DNA, 2685 bp, Artificial Sequence
  Synthetic Polynucleotide
atggccttaccagtgaccgccttgctcctgccgctggccttgctgctccacgccgccaggccgctcgaggggtctggaggcggaggcagcggcggaggcgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaaccgcgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagcatggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccggcggaggcggaagtggaggcggaggatctggcggcggaggctctgaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtggcagcggcggaggcggaagtggaggcggaggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcggactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1173 - DNA, 1923 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccggcggaggcggaagtggaggcggaggatctggcggcggaggctctgaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1174 - DNA, 2019 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccggcggaggcggaagtggaggcggaggatctggcggcggaggctctgaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1175 - DNA, 2169 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccggcggaggcggaagtggaggcggaggatctggcggcggaggctctgaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtgagcagaaactgatctcggaagaggatctggggagcggcaccccattcccttctctggcccctcccatcatgctgctggtggacggcaagcagcagatggtggtcgtgtgcctggtgctggatgtggccccacctggactggacagccccatctggtttagcgccggcaatggctctgccctggacgcctttacctacggcccaagccctgccaccgatggcacctggacaaatctggcccacctgagcctgcccagcgaggaactggcttcttgggagcctctcgtgtgccacacaggacctggcgctgagggacacagcagatccacccagcctatgcacctgtctggcgaggccagcaccgccagaacctgtcctcaggaacctctgagaggcacccctggcggagcactgtggctgggagtgctgagactgctgctgttcaagctgctgctgtttgacctgctgctgacctgctcctgtctgtgcgatcctgccggccctctgccttctcctgccaccaccacaagactgagagccctgggcagccacagactgcaccctgccacagagacaggcggcagagaggccacaagcagccctagaccccagcccagagacagaagatggggcgataccccccctggcagaaagcctggatctccagtccgcgccaagagaagcggatctggcgtgaagcagaccctgaatttcgacctgctgaagctggctggcgacgtggaatccaacccaggcccttctagatctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1176 - DNA, 1680 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1177 - DNA, 990 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggctttaccagcgagagctaccagcagggcgtgctgagcgccaccatcctgtacgagatcctgctgggcaaggccaccctgtacgccgtgctggtgtctgccctggtgctgatggctatggtcaagcggaaggacagccggggatga

SEQ ID NO: 1178 - DNA, 1374 bp, Artificial Sequence
  Synthetic Polynucleotide
atggactggatttggcgcatccttttccttgtcggcgctgctaccggcgcgcattccttcgaagaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctga

SEQ ID NO: 1179 - DNA, 876 bp, Artificial Sequence
  Synthetic Polynucleotide
atggactggatttggcgcatccttttccttgtcggcgctgctaccggcgcgcattccttcgaagaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagccccgagagcagctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagctga

SEQ ID NO: 1180 - DNA, 1503 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccggcggaggcggaagtggaggcggaggatctggcggcggaggctctgaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1181 - DNA, 1503 bp, Artificial Sequence
  Synthetic Polynucleotide
atggccttaccagtgaccgccttgctcctgccgctggccttgctgctccacgccgccaggccggaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctggcggaggcggaagtggaggcggaggatctggcggcggaggctctgagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctga

SEQ ID NO: 1182 - DNA, 2742 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccggcggaggcggaagtggaggcggaggatctggcggcggaggctctgaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtgagcagaaactgatctcggaagaggatctggcgaagcccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgacatctacatctgggcgcccttggccgggacttgtggggtccttctcctgtcactggttatcaccctttactgcgggcgcgccagagtgaagttcagcaggagcgcagacgcccccgcgtaccagcagggccagaaccagctctataacgagctgaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctctagaggatctggagcaacaaacttctcactactcaaacaagcaggtgacgtggaggagaatcccgggcctgggatccacatggccacttacgaggttctctgtgaggtggcgcggaaactgggcacggatgacagggaagtggtattgttcctcctaaacgtgttcatacctcaacccacactggcccaattaattggagctcttagagctttaaaggaggagggcaggttaacgtttcccctgttagcggaatgtctgtttcgtgcaggtcgcagagacctcttgcgcgacctgcttcacttagacccgcgttttttagagcgccacctagcgggcacaatgagttatttcagcccttatcagctcactgttctccacgtagacggggagctgtgtgcgagggatattaggtctttgatatttttaagcaaggacactatagggtctcgcagcacaccacagacattcttacactgggtgtactgtatggaaaacttagacctactgggtcccactgacgtggatgccctaatgtcaatgcttagatctttgtcaagagtagacctacagcgccaagtgcaaaccctaatgggccttcacctttccggcccatcacactcccaacactatcgccatacaccactcgagaccgatttctacgactacaaggacgacgatgacaagactagtggctccggcgagggcagaggaagtctactaacctgcggagatgtggaagaaaatcctggcccacatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1183 - DNA, 2562 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccctcgagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggccctactagtatggactggatttggcgcatccttttccttgtcggcgctgctaccggcgcgcattccttcgaagaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1184 - DNA, 2604 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccctcgagcctggtggcggaggatctcctgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtcctggcggaggcgggtctcctatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1185 - DNA, 2601 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccctcgaggttgcggcgctcgaaagggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtcgtgtggctgcgctcaaggagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1186 - DNA, 2589 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccctcgaggccgcagcaaaggaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtgaagcagccgccaagatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1187 - DNA, 2652 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccctcgaggggaaaccaattcccaaccctcttctgggactggattcaaccggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1188 - DNA, 2640 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccctcgaggaacagaaattgataagtgaggaagacttgggcagcggcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1189 - DNA, 2559 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggcatcaccagcgccagctaccaccagggcgtgctgagcgccaccatcctgtacgagatcctgctgggcaaggccaccctgtacgccgtgctggtgtctgccctggtgctgatggctatggtcaagcggaaggacagccggggaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcgacgtgaagctggtggaaaagagcttcgagacagacaccaacctgaacttccagaacctgagcgtgatcggcttcagaatcctgctgctgaaagtggccggctttaacctgctgatgaccctgcggctgtggtccagccgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1190 - DNA, 2781 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccggacagcctaaggccaatcctaccgtgacactgttccctccaagcagcgaagaactccaggccaacaaggccacacttgtgtgcctgatctccgacttctaccctggggctgtgacagtggcttggaaggccgatggatctcctgtgaaagccggcgtggaaaccaccaagccatccaagcagagcaacaacaaatacgccgccagctcctacctgagcctgacacctgagcagtggaagtcccacagatcctacagctgccaagtgacccacgaaggcagcaccgtggaaaagacagtggcccctacagagtgcagcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaagacgcgccaagagaagcggatctggcgtgaagcagaccctgaatttcgacctgctgaagctggctggcgacgtggaatccaacccaggcccttctagaggccatatgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggcgtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctga

SEQ ID NO: 1191 - DNA, 2445 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccctcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 1192 - DNA, 2445 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccctcgaggacctgaagaacgtgttcccacctgaggtggccgtgttcgagcctagcaaggccgagatcgcccacacccagaaagccaccctcgtgtgcctggctaccggcttctaccccgaccatgtggaactgtcttggtgggtcaacggcaaagaggtgcacagcggcgtgtgtaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagtgcgtgctggacatgcggagcatggacttcaagagcaactccgccgtggcctggtccaacaagtccgatttcgcctgcgccaacgccttcaacaacagcattatccccgaggacacattcttcccaagcagcgacgtgccctgcggtacccagagttttgggttgttggaccctaaattgtgctatctgttggacggaatcctgttcatttacggagtgatcctgaccgcattgttcctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 1193 - DNA, 2658 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 1194 - DNA, 2781 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgaggagtaagaggagcaggctcctgcacagtgactacatgaacatgactccacgccgccccggacccacccgcaagcattaccagccctatgccccaccacgcgacttcgcagcctatcgctccagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtgagcagaaactgatctcggaagaggatgggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaggagcaagcggtcacggctgctccacagcgattacatgaatatgacaccacgaagaccgggtcctactcgcaaacactaccaaccctacgcacctccccgcgactttgcagcgtaccgatctcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

SEQ ID NO: 1195 - DNA, 2664 bp, Artificial Sequence
  Synthetic Polynucleotide
atggccttaccagtgaccgccttgctcctgccgctggccttgctgctccacgccgccaggccggagattgtgctgacacagagccccgccacactgtcactttctccaggcgaaagagccacactgagctgctctgccagcagcagcatcaactacatctactggtatcagcagaagcccggccaggctcctagactgctgatctacctgaccagcaatctggcctctggcgtgccagccagattttctggctctggcagcggcaccgatttcaccctgaccataagcagcctggaacctgaggacttcgccgtgtattactgcctccagtggtccagcaatcccctgacatttggcggaggcaccaaggtggaaatcaagacagtggctgccctcgaggggaaaccaattcccaaccctcttctgggactggattcaaccggcagcggcgaggacctgaagaacgtgttcccacctgaggtggccgtgttcgagcctagcgaggccgagatcagccacacccagaaagccaccctcgtgtgcctggctaccggcttctaccccgaccatgtggaactgtcttggtgggtcaacggcaaagaggtgcacagcggcgtgtctaccgacccccagccactgaaagaacagcccgccctgaacgacagccggtactgcctgagcagcagactgagagtgtccgccaccttctggcagaacccccggaaccacttcagatgccaggtgcagttctacggcctgagcgagaacgacgagtggacccaggacagagccaagcccgtgacccagatcgtgtctgccgaagcctggggcagagccgattgcggatcccagagcttcggcctgctggaccccaagctgtgctacctgctggatggcatcctgttcatctacggcgtgatcctgaccgccctgttcctgagagtgaagttcagcagaagcgccgacgcccctgcctaccagcagggacagaaccaactgtacaacgagctgaacctgggcagacgggaagagtacgacgtgctggacaagcggagaggcagggaccctgagatgggcggaaagccccagcggagaaagaacccccaggaaggactgtataacgaactccagaaagacaagatggccgaagcctacagcgagatcggcatgaagggcgagcggagaagaggcaagggccacgatggcctgtaccagggcctgagcaccgccaccaaggacacctatgacgccctgcacatgcaggccctgcctccaagaagggccaagcgatctggatctggagcaacaaacttctcactactcaaacaagcaggtgacgtggaggagaatcccgggcctactagtatggactggatttggcgcatccttttccttgtcggcgctgctaccggcgcgcattccttcgaagaggtgcagctggttgaatctggtggcggacttgtgaagcctggcggatctctgagactgagctgtgccgccagcggcttcaccttcagcagctacgatatgagctgggtccgacaggcccctggcaaaggacttgaatgggtgtccacaatcagcagcggcggcagctacacctactacctggacagcatcaagggcagattcaccatcagccgggacaacgccaagaacagcctgtacctccagatgaactccctgagagccgaggacaccgccgtgtactattgcgccagacagggcctcgattactggggcagaggaaccctggtcacagtgtcatctgcatctacgcgtgagcagaaactgatctcggaagaggatctggggagcggcatccagaaccctgatcctgccgtgtaccagctgcgggatagcaagagcagcgacaagagcgtgtgtctgttcaccgacttcgacagccagaccaacgtgtcccagagcaaggactccgacgtgtacatcaccgataagaccgtgctggacatgcggagcatggacttcaagagcaactccgccgtggcctggtccaacaagtccgatttcgcctgcgccaacgccttcaacaacagcattatccccgaggacacattcttcccaagccccgagagcagctgcggtacccagagttttgggttgttggaccctaaattgtgctatctgttggacggaatcctgttcatttacggagtgatcctgaccgcattgttcctgaagagaggccggaagaagctgctgtacatcttcaagcagcctttcatgcggcccgtgcagaccacccaggaagaggacggctgctcctgccggttccccgaggaagaagaaggcggctgcgagctgcgggttaagttttccagatccgcagacgcacccgcttaccaacaagggcagaaccaactctacaatgaacttaatttggggcggagggaagagtacgacgttctggacaaaaggaggggacgagatcccgagatgggcggaaagcctcagcgaaggaagaatccgcaagaggggctttataacgaactccagaaagataaaatggcagaagcctatagtgagattgggatgaagggagaaaggaggaggggtaaaggtcacgatgggttgtaccaaggattgagcacagccactaaagatacctatgatgcgctccacatgcaggccctgccgccaaga

(The sequence listing continues in the following parts.)

What is claimed is:

1. At least one recombinant polynucleotide encoding a synthetic immune receptor-CD3-zeta (zSIR) heterodimer comprising two CD3-zeta (CD3z) chains, wherein each CD3z chain comprises the transmembrane domain and cytoplasmic domain of a CD3z protein; wherein a variable light (vL) domain of an antibody is operably linked to a first of the two CD3z chains via a first linker and a variable heavy (vH) domain of the antibody is operably linked to a second of the two CD3z chains via a second linker; wherein the first linker comprises an IgCL domain and the second linker comprises an IgCH domain; and wherein the vL domain and the vH domain are from the same antibody and together bind a target antigen recognized by the antibody.

2. The at least one recombinant polynucleotide of claim 1, wherein one or both of the CD3z chains comprise one or more co-stimulatory domains, wherein a) the encoded co-stimulatory domain comprises a cytosolic domain of 4-1BB, CD28, CD134, Dap10, CD27, CD2, CD5, ICAM-1, LFA-1, Lck, TNFR-I, TNFR-II, Fas, CD30, CD40 or combinations thereof; and/or b) the encoded co-stimulatory domain comprises the amino acid sequence selected from the group consisting of SEQ ID NOs: 4067, 4068, or a sequence having at least 85% identity thereto.

3. The at least one recombinant polynucleotide of claim 1, wherein the CD3z chain comprises a polypeptide having the sequence selected from the group consisting of SEQ ID NOs: 4064, 4066, 4075, and 4076, or a polypeptide having an at least 85% sequence identity thereto.

4. The at least one recombinant polynucleotide of claim 1, further comprising a nucleic acid sequence encoding an accessory module, wherein the accessory module comprises one or more of the following: 4-1BBL, CD40L, HIV-1 Vif, vFLIP K13, MC159, cFLIP-L/MRITa, cFLIP-p22, HTLV-1 Tax, HTLV-2 Tax, FKBP×2-K13, FKBP×2-HTLV-2-Tax, FKBPx2-HTLV-2-Tax-RS, IL6R-304-vHH-Alb8-vHH, IL12f, PD-1-4H1 scFv, PD-1-5C4 scFv, PD-1-4H1-Alb8-vHH, PD-1-5C4-Alb8-vHH, CTLA-4-Ipilimumab-scFv, CTLA-4-Ipilimumab-Alb8-vHH, IL6-19A-scFv, IL6-19A-scFv-Alb8-vHH, sHVEM, sHVEM-Alb8-vHH, hTERT, Fx06, hNEMO-K277A, shRNA targeting Brd4, or a combination thereof.

5. The at least one recombinant polynucleotide of claim 1, wherein the first linker comprises a polypeptide having the sequence of SEQ ID NO: 4027, or a sequence with at least 85% identity thereto, and the second linker comprises a polypeptide having the sequence selected from the group consisting of SEQ ID NOs: 4028-4035, or a sequence with at least 85% identity thereto.

6. The at least one recombinant polynucleotide of claim 1, wherein the vL domain comprises the sequence of any one of SEQ ID NOs: 4159-4190, 4118-4126, 4128-4158, 9659-9660, 11460-11462, 14386-14405, or a sequence with at least 95% identity thereto and containing the three light chain complementarity determining regions (CDRs) of the foregoing; and the vH domain comprises the sequence of any one of SEQ ID NOs: 4233-4264, 4192-4200, 4202-4232, 9690-9691, 11464-11466, 14417-14436, or a sequence with at least 95% identity thereto and containing the three heavy chain complementarity determining regions (CDRs) of the foregoing.

7. The at least one recombinant polynucleotide of claim 1, wherein the encoded zSIR binds to one or more disease-associated antigens selected from the group consisting of: CD5, CD19, CD123, CD22, CD30, CD171, CS1, BAFF-R, C-type lectin-like molecule-1, CD33, MPL, epidermal growth factor receptor variant III, ganglioside G2, ganglioside GD3, TNF receptor family member B cell maturation antigen, Tn antigen, prostate-specific membrane antigen, receptor tyrosine kinase-like orphan receptor 1, Fms-like tyrosine kinase 3, tumor-associated glycoprotein 72, CD38, CD44v6, glycosylated CD43 epitope expressed on acute leukemia or lymphoma but not on hematopoietic progenitors, glycosylated CD43 epitope expressed on non-hematopoietic cancers, carcinoembryonic antigen, epithelial cell adhesion molecule, B7-H3, KIT, interleukin-13 receptor subunit alpha-2, mesothelin, interleukin-11 receptor alpha, prostate stem cell antigen, protease serine 21, vascular endothelial growth factor receptor 2, Lewis antigen, CD24, platelet-derived growth factor receptor beta, stage-specific embryonic antigen-4, CD20, folate receptor alpha, receptor tyrosine-protein kinase ERBB2, mucin 1, epidermal growth factor receptor, neural cell adhesion molecule, prostase, prostatic acid phosphatase, elongation factor 2 mutated, ephrin B2, fibroblast activation protein alpha, insulin-like growth factor 1 receptor, carbonic anhydrase IX, glycoprotein 100, oncogene fusion protein consisting of breakpoint cluster region and Abelson murine leukemia viral oncogene homolog 1, tyrosinase, ephrin type-A receptor 2, fucosyl GM1, sialyl Lewis adhesion molecule, ganglioside GM3, transglutaminase 5, high molecular weight melanoma-associated antigen, O-acetyl-GD2 ganglioside, tumor endothelial marker 1, tumor endothelial marker 7-related, claudin 6, thyroid-stimulating hormone receptor, G protein-coupled receptor class C group 5 member D, chromosome X open reading frame 61, CD97, CD179a, anaplastic lymphoma kinase, polysialic acid, placenta-specific 1, hexasaccharide portion of Globo H glycoceramide, mammary gland differentiation antigen, uroplakin 2, hepatitis A virus cellular receptor 1, adrenoceptor beta 3, pannexin 3, G protein-coupled receptor 20, lymphocyte antigen 6 complex locus K, olfactory receptor 51E2, TCR gamma alternate reading frame protein, Wilms tumor protein, cancer/testis antigen 1, cancer/testis antigen 2, melanoma-associated antigen 1, ETS translocation variant gene 6, sperm protein 17, X antigen family member 1A, angiopoietin-binding cell surface receptor 2, melanoma cancer-testis antigen 1, melanoma cancer-testis antigen 2, Fos-related antigen 1, tumor protein p53, mutant p53, prostein, survivin, telomerase, prostate carcinoma tumor antigen 1, melanoma antigen recognized by T cells 1, RAS mutant, human telomerase reverse transcriptase, sarcoma translocation breakpoints, melanoma inhibitor of apoptosis, ERG, N-acetylglucosaminyltransferase V, paired box protein Pax-3, androgen receptor, cyclin B1, MYCN, Ras homolog family member C, tyrosinase-related protein 2, cytochrome P450 1B1, CCCTC-binding factor-like, squamous cell carcinoma antigen recognized by T cells 3, paired box protein Pax-5, proacrosin binding protein SP32, lymphocyte-specific protein tyrosine kinase, A-kinase anchor protein 4, synovial sarcoma X breakpoint 2, receptor for advanced glycation end products, renal ubiquitous 1, renal ubiquitous 2, legumain, human papillomavirus E6, human papillomavirus E7, intestinal carboxyl esterase, mutated heat shock protein 70-2, CD79a, CD79b, CD72, leukocyte-associated immunoglobulin-like receptor 1, Fc fragment of IgA receptor, leukocyte immunoglobulin-like receptor subfamily A member 2, CD300 molecule-like family member F, C-type lectin domain family 12 member A, bone marrow stromal cell antigen 2, EGF-like module-containing mucin-like hormone receptor-like 2, lymphocyte antigen 75, glypican-3, Fc receptor-like 5, immunoglobulin lambda-like polypeptide 1, biotin, c-MYC epitope tag, LAMP1, TROP2, GFRα4, CDH17, CDH6, NY-BR1, CDH19, CD200R, sLea, PTK7, gpNMB, CDH1, DLL3, CD179b, TCR gamma-delta, NKG2D, CD32, CSF2RA, TGFβR2, TCR beta1 chain, TCR beta2 chain, TCR gamma chain, TCR delta chain, FITC, luteinizing hormone receptor, follicle-stimulating hormone receptor, chorionic gonadotropin hormone receptor, CCR4, SLAMF6, SLAMF4, HIV-1 envelope glycoprotein, HTLV-1 Tax, CMV pp65, EBV-EBNA3C, influenza A hemagglutinin, GAD, PD-L1, guanylyl cyclase C, KSHV-K8.1 protein, KSHV-gH protein, autoantibody to desmoglein 3, autoantibody to desmoglein 1, HLA-A, HLA-A2, HLA-B, HLA-C, HLA-DP, HLA-DM, HLA-DOA, HLA-DOB, HLA-DQ, HLA-DR, HLA-G, IgE, CD99, RAS G12V, tissue factor 1, alpha-fetoprotein, claudin 18.2, P-glycoprotein, STEAP1, LIV1, NECTIN-4, CRIPTO, GPA33, BST1, low-conductance chloride channel, integrin β7, MUC17, C16ORF54, VISTA, MUC5AC, FCRH5, MMP16, UPK1B, BMPR1B, LY6E, WISP1, and SLC34A2; or combinations thereof.

8. A synthetic immune receptor-CD3-zeta (zSIR) polypeptide heterodimer, encoded by the at least one recombinant polynucleotide of claim 1.

9. At least one vector comprising the recombinant polynucleotide of claim 1, wherein the vector is selected from the group consisting of one or more of a DNA vector, an RNA vector, a plasmid, a lentiviral vector, an adenoviral vector, a retroviral vector, and a Sleeping Beauty transposon vector.

10. A recombinant cell comprising at least one recombinant polynucleotide of claim 1, wherein the cell is an autologous or allogeneic cell, optionally selected from the group consisting of a T cell, an NKT cell, an NK cell, a hematopoietic stem cell, an embryonic stem cell, and an induced pluripotent stem cell.

11. A composition comprising a recombinant cell of claim 10 combined with a pharmaceutically acceptable excipient.

12. A method of treating a disease associated with the expression of a disease-associated antigen in a subject comprising administering to the subject an effective amount of the composition of claim 11, wherein the disease is selected from the group consisting of a cancer, an autoimmune disease, an infectious disease, an allergic disease, and a degenerative disease, or another disease associated with the expression of a disease-associated antigen.

13. The composition of claim 11, further comprising a stem cell wherein one or more target antigens of the zSIR have been deleted or mutated to a form no longer recognized by the zSIR, optionally wherein the one or more target antigens are selected from the group consisting of CD19, CD20, CD22, CD33, CD45, CD123, MPL, CS1, and BCMA.

14. The composition of claim 13, wherein the stem cell is an autologous or allogeneic hematopoietic stem cell.

15. A synthetic immune receptor-CD3-zeta (zSIR) polypeptide heterodimer comprising two CD3-zeta (CD3z) chains, wherein each CD3z chain comprises the transmembrane domain and cytoplasmic domain of a CD3z protein; wherein a variable light (vL) domain of an antibody is operably linked to a first of the two CD3z chains via a first linker and a variable heavy (vH) domain of the antibody is operably linked to a second of the two CD3z chains via a second linker; wherein the first linker comprises an IgCL domain and the second linker comprises an IgCH domain; and wherein the vL domain and the vH domain are from the same antibody and together bind a target antigen recognized by the antibody.

16. The zSIR polypeptide heterodimer of claim 15, wherein the first linker comprises a polypeptide having the sequence of SEQ ID NO: 4027, or a sequence having at least 85% identity thereto, and the second linker comprises a polypeptide having the sequence of any one of SEQ ID NOs: 4028-4037, or a sequence having at least 85% identity thereto.

17. The zSIR polypeptide heterodimer of claim 15, wherein one or both of the CD3z chains comprise one or more co-stimulatory domains.

18. The zSIR polypeptide heterodimer of claim 15, wherein the CD3z chain comprises a polypeptide having the sequence selected from SEQ ID NOs: 4064, 4066, 4075, 4076, or a polypeptide having an at least 85% sequence identity thereto.

19. The zSIR polypeptide heterodimer of claim 15, wherein the vL and vH domains bind to one or more of disease-associated antigens selected from a group consisting of: CD5, CD19, CD123, CD22, CD30, CD171, CS1, BAFF-R, C-type lectin-like molecule-1, CD33, MPL, epidermal growth factor receptor variant III, ganglioside G2, ganglioside GD3, TNF receptor family member B cell maturation antigen, Tn antigen, prostate-specific membrane antigen, receptor tyrosine kinase-like orphan receptor 1, Fms-like tyrosine kinase 3, tumor-associated glycoprotein 72, CD38, CD44v6, glycosylated CD43 epitope expressed on acute leukemia or lymphoma but not on hematopoietic progenitors, glycosylated CD43 epitope expressed on non-hematopoietic cancers, carcinoembryonic antigen, epithelial cell adhesion molecule, B7-H3, KIT, interleukin-13 receptor subunit alpha-2, mesothelin, interleukin-11 receptor alpha, prostate stem cell antigen, protease serine 21, vascular endothelial growth factor receptor 2, Lewis antigen, CD24, platelet-derived growth factor receptor beta, stage-specific embryonic antigen-4, CD20, folate receptor alpha, receptor tyrosine-protein kinase ERBB2, mucin 1, epidermal growth factor receptor, neural cell adhesion molecule, prostase, prostatic acid phosphatase, elongation factor 2 mutated, ephrin B2, fibroblast activation protein alpha, insulin-like growth factor 1 receptor, carbonic anhydrase IX, glycoprotein 100, oncogene fusion protein consisting of breakpoint cluster region and Abelson murine leukemia viral oncogene homolog 1, tyrosinase, ephrin type-A receptor 2, fucosyl GM1, sialyl Lewis adhesion molecule, ganglioside GM3, transglutaminase 5, high molecular weight melanoma-associated antigen, O-acetyl-GD2 ganglioside, tumor endothelial marker 1, tumor endothelial marker 7-related, claudin 6, thyroid-stimulating hormone receptor, G protein-coupled receptor class C group 5 member D, chromosome X open reading frame 61, CD97, CD179a, anaplastic lymphoma kinase, polysialic acid, placenta-specific 1, hexasaccharide portion of Globo H glycoceramide, mammary gland differentiation antigen, uroplakin 2, hepatitis A virus cellular receptor 1, adrenoceptor beta 3, pannexin 3, G protein-coupled receptor 20, lymphocyte antigen 6 complex locus K, olfactory receptor 51E2, TCR gamma alternate reading frame protein, Wilms tumor protein, cancer/testis antigen 1, cancer/testis antigen 2, melanoma-associated antigen 1, ETS translocation variant gene 6, sperm protein 17, X antigen family member 1A, angiopoietin-binding cell surface receptor 2, melanoma cancer-testis antigen 1, melanoma cancer-testis antigen 2, Fos-related antigen 1, tumor protein p53, mutant p53, prostein, survivin, telomerase, prostate carcinoma tumor antigen 1, melanoma antigen recognized by T cells 1, RAS mutant, human telomerase reverse transcriptase, sarcoma translocation breakpoints, melanoma inhibitor of apoptosis, ERG, N-acetylglucosaminyltransferase V, paired box protein Pax-3, androgen receptor, cyclin B1, MYCN, Ras homolog family member C, tyrosinase-related protein 2, cytochrome P450 1B1, CCCTC-binding factor-like, squamous cell carcinoma antigen recognized by T cells 3, paired box protein Pax-5, proacrosin binding protein SP32, lymphocyte-specific protein tyrosine kinase, A-kinase anchor protein 4, synovial sarcoma X breakpoint 2, receptor for advanced glycation end products, renal ubiquitous 1, renal ubiquitous 2, legumain, human papillomavirus E6, human papillomavirus E7, intestinal carboxyl esterase, mutated heat shock protein 70-2, CD79a, CD79b, CD72, leukocyte-associated immunoglobulin-like receptor 1, Fc fragment of IgA receptor, leukocyte immunoglobulin-like receptor subfamily A member 2, CD300 molecule-like family member F, C-type lectin domain family 12 member A, bone marrow stromal cell antigen 2, EGF-like module-containing mucin-like hormone receptor-like 2, lymphocyte antigen 75, glypican-3, Fc receptor-like 5, immunoglobulin lambda-like polypeptide 1, biotin, c-MYC epitope tag, LAMP1, TROP2, GFRα4, CDH17, CDH6, NY-BR1, CDH19, CD200R, sLea, PTK7, gpNMB, CDH1, DLL3, CD179b, TCR gamma-delta, NKG2D, CD32, CSF2RA, TGFβR2, TCR beta1 chain, TCR beta2 chain, TCR gamma chain, TCR delta chain, FITC, luteinizing hormone receptor, follicle-stimulating hormone receptor, chorionic gonadotropin hormone receptor, CCR4, SLAMF6, SLAMF4, HIV-1 envelope glycoprotein, HTLV-1 Tax, CMV pp65, EBV-EBNA3C, influenza A hemagglutinin, GAD, PD-L1, guanylyl cyclase C, KSHV-K8.1 protein, KSHV-gH protein, autoantibody to desmoglein 3, autoantibody to desmoglein 1, HLA-A, HLA-A2, HLA-B, HLA-C, HLA-DP, HLA-DM, HLA-DOA, HLA-DOB, HLA-DQ, HLA-DR, HLA-G, IgE, CD99, RAS G12V, tissue factor 1, alpha-fetoprotein, claudin 18.2, P-glycoprotein, STEAP1, LIV1, NECTIN-4, CRIPTO, GPA33, BST1, low-conductance chloride channel, integrin β7, MUC17, C16ORF54, VISTA, MUC5AC, FCRH5, MMP16, UPK1B, BMPR1B, LY6E, WISP1, and SLC34A2; or any combination thereof.

20. The zSIR polypeptide heterodimer of claim 15, wherein the vH and the vL domains comprise:

a vH domain of an antibody having the sequence selected from SEQ ID NOs: 4192-4264, 9662-9691, 11464-11466, and 14417-14446; and a complementary vL domain of the antibody having the sequence selected from SEQ ID NOs: 4118-4190, 9631-9660, 11460-11462, and 14386-14415; wherein the vH domain and the vL domain are derived from the same antibody.

* * * * *